United States Patent 12,016,313 (HUMAN ANTIBODIES FROM TRANSGENIC RODENTS WITH MULTIPLE HEAVY CHAIN IMMUNOGLOBULIN LOCI) - sequence listing, part 2

SEQ ID NO: 11 - DNA, 547891 bp, Artificial Sequence
  Description of Artificial Sequence: Synthetic polynucleotide
  BAC6-3 BAC3 Annabel  seuqences in tandem
  modified_base (496443)..(496572): a, c, g, or t
  modified_base (528461)..(528510): a, c, g, or t
  modified_base (540084)..(540488): a, c, g, or t
  modified_base (543645)..(543652): a, c, g, or t
atcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataaagatcccccgaacacaacccacagctaccaccatcaacaatatttatatatataacgtacacatagaaatcacacaaacagagtatttattcttaactacatgaactaccatcagaccgtctgggccactatataatgtgccattcataaacgtgatcactttacgtagcaggcaaccccaggtgaaaatttttcagcgagctgccagattgtcaggtgaaaaactgaaaaaaacttctgggcgatgagcttgtggcgggaaattaagtatataaagcagttagtttcttctgcttcttgtggttctgggtattcttgtaatatttggaagaatagaaaatcaagactactgcctttcttttcatattatagaggaagaaatacgcacgaacacgatatagaggtaaagggggagtctggcaacccttcttgccactcatgtcccagctctcaccatgtgacatagcctgttccccctttgccttccatcatgattgtaaagtagatcctggtgccatgcttctcacacagccttcagaactgtaagccaaatgtgcctcttttctttgtaaatcacttggcctcaggtattaatttataggaatgcaaaagagactaacacaccgtccaaagcattacacagattcaactctatttttatcaaatgaccaatataattgattacatatttagaaaaaaaatactaaaattcctatagaatcaaaaaagagtctgaatagcaaaagcaatcctaagcaaaaagaccgaagctggaagcaccacattctctgacctcaaattatactacatgaatataataagaaagacagcatgctactagtagaaaaaaatagcccagaaagaaagccaaatatctaaaaccaactgttgtttgacaaaactgacaaaaatatacactggagaaacaaccctctattcaataagtggtgccgggaaaattaggtggcttatgtggaagaatagaactagacttccatatcaccgtagacacaaattaactgaatatggattcagtgtttaaatttataaactaaaactataaaaatacttgaataaaatctaaaaagagtcctctggacattggtctaagcaaacaatatatgactaagacttcaaaagcaaatgcaataaaaacagaagtagacaaacaggatttagttgaactaaaggtcttctgcacagcaaaagaaataaccaacatggtgaccagacaatctgcaaatggaaaaaatatctggaatctattcatcttgcaaagggctaatatatagaatctacaagtaactcaaataagtcaactaaaaattacaaataacttcattaaagaatagacataaacagacatttatcaaaagaatacacagaagtggccaacacaaataagaaaatatactcagcatcaccaatcatctgataaatgtaaattagaaacaacatgatacggcatcttccaccagtcagaatggctgttattacaaataaaaacagcaggtgtttgcagacaaacataggaaaaataatgatttatatatgcttggtgagaatgtaaattagtacaacctccatgaaaaacaacatagaaatttctcaaagaactaaaattagaattaccatttcttccagtaagctgtcccagtaggcatgttcctcccaaacttttatatcagagaatgttgcctgcactcatatgtttatttcaacaccattttcaatagaaaagtcaaataatctaagtgtcaatcagtggatgattagataaaatatgatatatgtaaatcatggaatactatgcagccagtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgcagatcagcagcctaaaggctgaggacacggccgtgtatgactgtatgagagacacagtgtggaaacccacatcccgagggagtcagaaaccccgagggaggaggcagctgtgctgagctgaggcagtggtgcagcagtttctttaacttccatatgatctcattttgcatcatcttctacttttatattagctaagaacttggggtagacaggtgctcctaagagatccttaacttgcccattttgatgggttttccagaagacgtgagaagccactttgttagcaaagcatcccaaatccatgccctgttctagatacatgtgagcccatttcctggtctttgcttaactgacaagctctcatcagtgcacctgggctaatttcacatcaggtagaggaacgcgttataaaggaaagctaatgttgtaatagcaattcctgcttaaaaaccttcagcttcattgtttttgtgtaatccatcagcaaattatgttagttcaaggttctcaatgggagtttctaataaatagaaaggatgtataaagcttcccctaattaaaatgaaacaattgtgaacacaacctcggtattcagccatgtctccacccttcacacccttcgccacaaaggaattttcacctctcctggaagctgggttcattttcaaattagttatttttttcaatgtaatatctcaagattatcgtatatgactattttagcagaaagtgaattatgggaacttgaactaaacaactgaaaacaaattcacaactaattaaacaagatgccagaatgtgattggctccaggctttgtaattcagcagttcatgtacccagactggaaatttacatgtcttcttgttaccttcacagcacagtcaactcccattatgtaagaaatggtgactgcattcccaagggttatgcatagatatgaaaatagactgggtaaggtgaggagttgattgtttaaattcccctctgaagaagcagcatcaactcaacaaaccacctctcttcactctgtgactagagctatgtcacaggccacatggacctaaatccttgatggatataacatgactacataaattgggctgatcatttttatgctataaaattaatagatgacactgcactccagcctgcacaaccaagcaagtcttcatctgtaaaatctaaaaaagaaaaattaataggtactgacttcgaaatttttgataataatattttcaccacccaaatttaatcacacccacatgttacctgcatcttcactgaaaagttcccagtcacgatgagttccttcaatgctccatgtgttcaaatctggacatcaagagagtccagagaataaaacacaatgacggcagtgaaactgatatatattcagcacctcttaactcaggaggactccatacaccctggcacacagctgcttttctaaatggctcacaatgactccagctcactcacagagctcagacagaaacctcccttcagggtgggagctgggtggcagggggcactcagtacccgcagaggtgaaaatgagctttcagatggaacttccctgtcacctcaacatggaatttattgtttcatttcattacctctctttccataatggttcatttcttttggcctgttcattactgatatttttcagagcaatctcacttgaatctttactcttttgcattttgtctccttgacaatgttgggaagttttacctccagcatcataacatgatctagtgatctgacacattgtgcaaacaatacctacaaattcagaacctctttgtttttctttccacaaaatataattctttctgttctgtgtatgagcatgtcttagcaaccctgtacacacccacatagatgtctacaagcctatgaattgttctctgtaaataaaaatttatctcaaattccttcaatgttcataattctgagagtgaggaaggtccttctcaatctgttcaaacaaaatgcccagagaccatccagtaggtaaggagttcacctggctctggtgtggggtctgtctctttccctctgttgtcccacaggtcagcccagttgttcacgtcctaacaagaaagcccaggtttgtcctgattttaaaacacatcaaacttctgatgactctcctgttacccacatccatggagatagattatttattatataattcagcaaactaatgtcaaatgcccaagttgcaataccgcacatcctagggtatgttcatgcaattcaatggaggagaaaatctttcagagacagatggatctgaaatgataaatatgtgggtaaggactctgggcttgagtatcattgtccagccatgtttcacaagtgtgtcctgtcagggaaggatcagagttccttgtgctctcagagggaaggggtcacagagttcctctctggttcccaggaaaggtaatcgcactaatcttcatgatcttcatgagactatcctccagtgctgacctgttacggagtttttgtctgaagttctcactgcaatccccaatctacatattttcaatcagaagtgtttagaggccaggacacatcttcaaggtcacacattgagaagtatggagatatgtcccactaccttctcctacgatctcagacagaatcccaaatttcaaaaggacacagaaggacagctctcaggtgcttttaaaaaatgacccacttccagggacagtgagcttccctgtaaccatggtggatgttctgaactacaataaacattggatggatccagtattgtttgaagtcactgtcattattacattcagctgttgtttcaatgtgtctgaaagggtaaatgactatttagatggcctgggtgtgtggttggttttatatgaatctttaagggttgaacagtactgaccctattccaaaatctgtccttgatccaggatcacactcatctctcagaccagctccttcagcacatctctttacctggaagaagaggactctgggcttggagaggggaggccccaagaagagaactgagttctcaaagggcacagccagcattctcctcccagggtgagctcaaaagactggcgcctctctcatcccttttcactgctccgtacaaacgcaccacccccatgcaaatcctcacttaggcgcccacaggaagccaccacacatttccttaaattcaggtccaactcataagggaaatgctttctgagagtcatggatctcatgtgcaagaaaatgaagcacctgtggttcttcctcctgctggtggcggctcccagatgtgagtgtttctaggatgcagacatggagatatgggaggctgcctctgatcccagggctcactgtgggtttttctgttcacaggggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacacacagtgaggggaggtgagtgtgagcccagacaaaaacctccctgcagggaggctgagggggcgggcgcaggtgcagctcagggccagcagggggcgtgcggagctcacggaatacaaggccgggtcaggagcaggtgcagggtgagcggggcttgctcatcttctcagtcgtctccctcctcgccagcacctcagctttccgtagaggtcctctttctttattgtgtgtggttctacttcctcacatccttgtgccaggaaagaaaggagtaaggcaaattttcctgttacaattgaagtttcaccaattactaagaactttcctgcaagtacctgcacagcccattataccttatttatatatgtatatattctaatgcttctcaccatctcttgatttgtgtcatcaatttaattgtgccctttttgaaattcatatgctgaaactttaaatccaatggatctatatcggaattttaatggtataattaatgttaaatgtggtcataaatgagaccctaatgcaatagagctgttgtctttataagaagaggaagagacaccagatacctctcacttctcacatgcactcagagaagaggccacgtggagacatagtgcactagaaggtgggcctctgcaagccaggaagaagccgcaccaagaaccaaccctgccagcaccttgatcttctacattcagactgcagaattgtaagaaaatcaatatttgttgtttaagccacccactccttttgtcttcttacgaagacccagacaggctaataccacacaactctgttagctccgtctcctggagggagaagcagccccctgaagctgggcacatcgctcagattttcacatgaattaggcaaaaacagtagctctcatataaaaactgtcacgtccctgttgggacaaggtcttttaaacaagccctggggctttgtcacaaatgttgcattttatcctttattaggacttaactaattgacaatgagtaccagctggatggaaactgaccactgaccatcttctgctgtctccttattatatcacagaaaaccacagcaacattactctatgtcttcaactttctaaatttgtactgaatctattgctaaatgaggagctacatggggtctgagttttgttaccttcttcccagtcttccccaattaccaagcatagaagatactttcagtgaaatttagctgtcaatgcccccgacaccacatcatgttttaaggtccaaggactttctttggggggctattgaaaaacacttttgaatggaaaatcctaaagcatacaacagctgaaagaatggcccctgtgcacatgaaggctgaagggatggatgatagggtacgttcctccaaggtgttcctgggcatgtgatggttggatacctcatgcatacgaaaacaaggactgaactgagatagaaacaagggccatatcctataggaaaacaagaaaaaaacgggcatccctgaagagagttaattagacttggtgggtttaagatgaatttttttccaaagttttttaatgttctaagctaaatatgaatattttcaataaactgcaaattaaaaggagaatgaatttagaagtttagacagaaaaaagccatgagggtgtagaaagcaaatccacacaaaactgtcacatggcagaggccagaatggagctgatgcagctacatcattattctgcagacctagttgagaccctttggtgtttaaggcaggtccagcagtgaagaactcctttattttttgtctggcaaagttctaatctaatcttcatttctgaaaaggatttacatggtaaagattcgtcttggcaggttttatttatttttagtcccccccaacccacgtcaatttgagtaaagtcatgtgttacgtaacaatgctgcagtcaacagtagaccacatatatgtttgtggccacataatgttgtaataccatattttcactaaactttttccatgttttgatgtgtttagatagagagatacttaccatggtgtttccatttcctgcagtgttcagtgcagtaacacgctgtacaggttagttgtctgggaaccctgcgctaatccacataccctgtgtgtagtagggtattccttgtaggtttgtgaaaattcacccttgatgcttgcacaatgatgaaattgcccagggacacatttctcaaaaagaacctctgtcaataaaccacacaccattgaatacaatccctgtgccttctgaactgaaaaccttctgctgagaaatctgttccttttctttctgttttctaaagcctcttttatttccagcaatgtggttttaaactgtgtcacattttttgtcattgggtttatcttacgtaaaatttatagagcttcttcattgtggatgaatatttgcttcccttctccaaatttggaaatattttttgctattattttgaataatttatctcttctctctctctctctctctctctctctctctctctccctctctctctctctctctctctctctctctctctctctctctctctctccccctctctcccttcactaccccttttgtcttgtctttgtataactcctcaaatgcgtagttgagtgtttagtgtctttcctggcccataagtcttgaactcttttttatttctttcacttaaatttttcttctctgtctctactatttcaaatgatctttctttgagtttactgtttcttctattacttgatctagtttggtctaaaatcttgttaaaatttttggctgtattcttcaggatcaatatttttgtttagtcatcttttaaatgttttatctttattaaaattctcacattgttcttgcatgctgccactagctcattgaacatgtttctaacatttactttaaagtttctgtcaggtaatccatgttcttccttttcattgatgtcagtttatggaccttttggttgttcttctgtttggaccatgttcccctgcttcttcattttccttgactgtctttgttgttatctgttctttataacaaaagccatcatatacttcttcaaagactaggctcatagagatcaccctcaccaatcagcccagacagtaattgtgggtctctcaaaacttgataggattcaaacttctgtctgttcttagtggcccctaggttttagaggatgatagattgtgccaggactcacaggtaagggaggtagaaactatgtactcatgaccatggggtctgtgctgatctgagcttctcttgtcatcactctcaatattcaacttccccgtggatcaggctcagctgtggctgctccacgtggggctgttctcagtctgttgcctctgtgtgtgcagaagtcctctgtgaagttaactagtggagtcagacaggaaaatactacagaccaagaattctcagactgttctgcaaagcccctggattcactgaaaaaagaacaagtttggtccagcaggattcatggcaagtgttggtgagggagataacagtaattcaagtggaagttctcaatgggactcgccttcagtacaaagaagattaacagtcctcagagacactgttcagaagattctcttttaagataataaaactgagagcccaagacaagtctgtgtattactgtgagggacacagtgtggggacatctatgtgagcacagacacaaaagtccctgcagggagacaggaggggactgcatgttagttgctgctcagaaccaccagggggcattcaggacaccagtaggcactcagaaccaccaaggagagctcagaatcaccagggggcactcaggaaactggcaggtgctcagaaccaccaaggggcgctcaagatcccagcgggagctcataaccaccagggggcgctcaggacactagggggctcagaaccactagggggcgcccaggaccaccaggtctctcaagacaggagggcgcactcaggacactagggggcgctcagaaccatcagggggcaatcaggacaccagagggacttcagaaccaccagggggcgctgagaaccaccagggggtgctcaggacatgaccggccctcaggaccaccaggggatgttcagaacaccaggaagcactcaggacaccagagagcgatcagaacaccagggggcactcagatcctccagggggcactcaggacaacagggagctctcaggacaccagggtgagctcagtaaaccagtgttcgctcagaaccaccagggagcactgaggacaccaccgctcccttaggaggcagctccacatcaggtccctggatccgggcagggagggcggttccttttggatcttgccactaaccttttgggagttttcctgcttcctttgtggtttcaagaatcatttgcagattcttctcatgtacaaagctctgctttcttggattatgtaatgtttttggctttggatgctaccagaattacgttgtactgtgagaggattcattcgtggtgtgtgcaatagtgaatgaaagctccaatgttaggggtggctttgaaagctacgttaggggtggctgagggcagttagcagaaaatgatcatcactatagaaggctactcatttctttgcacatttgcataaacaattgtagtttatgccctaaaaactgcatgttttcttggccctttttcttaaatggctccactctaagtccagtaatctaattaagctgtgtttcaaagaccaccaatcaagttaattctgtttaatgcaacactttgtaaagaaaatgtacatctgttttttagagtcagctttaaattttacattactttacaaatattgatttgtcaaatttagtctcataactatcttcagtaatttaaaatcttagtcatgtcatgttaaattaagtaatcctaggtttctcacttgaattagggttactaagaattagaatagtaaaagagtataattagcttttggtgaggtttataaagaaagatgaggatttttttttttttttgcttaaaaatattctgttttccagtttacagggcttttcaactggttttaagataaccactgtttacatctaaacttttttttgtaaatgactgctgagtttctatacatattccatagctagagtttcaaagtaaaagctctagtatctttgtattagtgtgtgtatgcgtagatgtgttaatatgtgcatgtatatatatgtgtgtgtgtgtgtgtgtgtgtgtgtgtgtgtgtgtgttgtggctactaggtacaaaattggctttgaaataaatattttcaaattaagtaaatgagcccaatgcatttgaagtacatgtgacttaaataaatatttaataaataagttggctttaaaattattggtaaaaacaaattagagatattttaacaattatcagcataccttatagtttatattaattcatcaagtgattttatatttaaaatcacagctagatattatatggtgtcaaaattttttatgatgattataaaattattaacctcgttggccatatgcggtggctcacacctgtaatcccagctctttggaaggctgaggtgggtggatcacgaggtgaggagattgagaccatcctggctaacatggtgaaaccccatctctactaaaaatacaaaaagaaaaaaaaaattagctgggcatgctggcaggcgcctgtaatcccagctactctggaggctgaggcaggagaatgcttgaaccccagaggtggagcttgcagtgagctgagatcgcaccactgtactgcagcctggatgacagagcgagactccgtctcaaaaaaaaaaattataaacctcattaaaaccagaatgatctttgtaattttttgacaaatatgatgtttaatattgttgttttaataaaaaacaggtaaatagttattagaaaaacaattatttgcttaattataaggtttttactcaggcaagcacctgaaattcatgggttataacatggttaacagagaaaaaactttaaaggatgaattacaattttcataagtaatctagataagctacttaaataaaatagggaaatgtaatcaaataaaccttttaaataaacttgttctacaatttaaaaatctaaagtttaattaaataatagatattgactaaatgtttaggtcattactaattgttttaaaaaatatataagaaaatatttttcttaaaaaattattcttagaaaaataatgtaattcaaagttatttatataacatcataaaaagtaagagagttttaaagaaatttattgacatagagaagtacttttggtaagaaaggttaaaataaaaaaattttatatgagaaataatcttgcatggtaattttttatcctaaaataaaatgactaagaaagaatgacgtttagaataaaacaagatgttcaactatgccataaatggtttgtgtaagtgaaaataagatttataaaaagttaatttattaaaaaaccttcatattatcaagttgactataattgaaagggaagtatttataatagtctttatagagatctggcttttatataaaatatagtaatacactgaagactggttagaatgacaaaattgtcttaaagtgttgatttactaaataaaattataagatattttaattttttaacccccaaatttaacttttattgcatcttgccattttgattttttccctttgagaagacttgagaggctctccattttttcatcacgtcctttaacattttttttcttacagcgattagcttcttactgacttaacttctaactgttgttagcttttaactgctattattgtctgatgctaaaaacattttatctttaagttctaaataaaatgttttctttcaatataacattctacactcttggcttatctttaaatgtctacatttttctatgaaaccaaagtcttcacgtgtaatctgagtcacattcttggtatgtctaattaattcaaatgcttttttcattagagttgacctgcaggttatctacatgcattttccaatagggaaaagcaatcacactgtaaaaggttttgctttgctatttggtaactggcataaaacaaattttatattttattgaaataattcctatgttactgttattaaggtttccaacttactgagattttaagaaaatataaattaatgttattacattcatgtagctatctacattacttttaaaggccttgtgctgccacattactgacctttgactcctaggtctaaaaaggacacacagcattttgggagactaaggcaggcagatcacctgaggtcaggagtttgagaccagcctggccaacatggcgaaaccctgtctttataagaaatacaaaaattacccaggcatggtggtggatgcctgtaatcccagctacttggaagcctgaggcagggagaattgcttgaacctgggagacagagattgcagtgagccaagattgtgccactgaactccagcctgggtgatagagcaatattccatctcagaaaaaatatataaataagagaaaaaggacactaagtcctgctaaatcttaaacactgacagtaattaaagccccatctacagacctggaagaaaatgacaataaaaattcatcatactcttaagacataaggccagaaattgaaactactcaacaactccaggcccagggactattacagaagtggatttgtaagattgtaaaagctaattttgagatataatattacttgagagtttctttataagttaagcattaatattaaatgcacactaatggaagtctagcatctgggcccctgtgacagattgacaagggtttcttgaagaagtaatccactctttagcttaaaaaattattaaaatttataaaagacctatgaaaattatattttatggtaaaagtagttataatttaatagacttatttctcagaattgagagatagttttaatttttctcatgatgttcttataaggggttattgtttagaaaattaattctttcaaaaataaaagtttttgcttttttaagaaatcactgagttttcacttggctaaataaataacttactttacaataatctgtaattccattttgtaatatcaagtgttctaaataaacctttgatatttgacctccttcacaaaataaaagtctaaattcagtcatttgacctcattattcttttttgatatttgatctcctgaagccaaaaagaaacatatttagcttctttggtacaattaaattatactggaagcaatgtcaaatttgaaatggtgtttaactttggactatatttatataaatgtggactatataattggagtatattcatataaattaaagagtacatgttctaaaatggtatgaggttcaattgactttgatatgtcagtatattttgtcagtagtacttatgattattatataaaatttttgttcatcacagaaataaccaaactttctcctcaattctgtctttaaccgtggctattctaaaacttcagccatccacaattgttttcctttgattctttatcaggtggcttataataatctatagaattttgaggggtactcttaaatacacaattgtgacaattttataaattgtgccatttatatacagagaaaaacttccaagactctcatggagacctgatgcatttatgatggttgttaatataatgtcaaacaggacaggacttaattgcatgaactgaactaacaggagcctgaaataaattttatggcttattctttaaagcatttgctaattacttacattttgtttttcagaatcaaaaaaaaaattctcttaagctattcattgtttttaacaattgagtatagtatattctagtgagaaaattcaaaaacacaatttcttcttctctacataatttctccaaaatttggaaactgtgagtattgttatatcaaaatattaattcacataggttcaatataaatctgctttcttccgtaacagggcacaattggagacaatgatcattttaccaagactttaacttgaatgacatattttcatatttactttataaaatgaatttaagctggatagctgataaaagccccttgggaaaactggcatgtaacctgttttgttcagggccctgagctgtagtaagtcaataattttactttctgacagacccaggaatcccaagttgtcttggaaaattgaaaaaagaagaagtaacccaattcatatagctgtctgaaggcacagatgaaacaatgtctgggcttgatgcttttaaagattctacccttagatttcttataaaaaatttccagcaaggtcaatttatgaattaaatagcctatgtacaaaaaatagaaaaaaagagagctaatatgttaaattactatttttgcctcatcttatacaaaaaaattaagcctaaaacttatattacaaataaatttgccctactatgattgtgtctctaataactttggggaattatagagagaaatactgtttcaaaataaacaacagtgcatctgttattagattctaaccttgtccacttgtttttcaatttatattattttctacaatttatattagtttctacaatttatattagtttctataaaaatttatatttgcagaagcctccaaaatatttttcctgatttaaaattaccagaagttaaactgtgctttcttatagctagacatcttatactctaaagaaaataaaatcaatgacatgatttggctctgtgtccccaccccaatctcatcttggattgtaataattcccacatgtcaagtggaaaaaggtgggaataattgaatcatggaggctgttttctccatgctgttctcctgttattctcacaagatctgatggttgtataaggggcctccctcttcccttggcacttctctcttgcagccatgtgaagaagcacgtgtttgctaccccttccatcatgattgtaaatttcttgtggctttctcagccacgcagaactgtaagacaattaaaccttttttctttataatttacccagcctcaggtatgtccttatagcagcatgaaaacggacaaatgtaagcaacttaattatatacaaaaactcttttatacctgcctactgtgaaaggaaaataagtcttgagaccgcaaaatcaccaagctaaatggaagagtcaaactggtgttacaggagatagaaagaaattattttggtagatagttaggatgacagaatttctgccgaaaacatttcttctaacaaaaatcagcttggcaattacttattttctattcacacagagttcaaagaaatcacttctaacaaaaagcagcctgaaagatcaggctgtaaaacatataagcaactctgccacagagagggtgtttctgggtgtaatcaccaaacttcacatacatacactgggccctagtaaaaacagtgggccttaatgagcacattcctttccttttctgggggcactataacatcagaaagctggaaacttgcacaagtttaggatgcctgcacttgcaaggaggtacctgggacctagcatggaaaatcctcttcccctttttagcactctgggagtggagccccagccttgggattcccaggtgtttcccttcagtgatcaggactgaacacacacaactcatcatgcagtttgtgctgagctgggttttccttgttggtattttaaaaggtgattcatggagaactacagatgttgagtgtgagtggacatgagtgagcaaaacagtgggtttgtgtggcagtttctgaccttggtgtctctgtgtttgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatacacagaggggaagtcattgtgcgcccagacacaaacctccctgcaggaacgctggggggaaatcagcggcagggggcgctcaggagccactgatcagagtcagtcccggaggcaggtgcagatggaggctgatttcctgtcaggatgtgggacttcatcttcttccaacagtttctctaatgaacctccctaattttagaattctgtggttcctaatgtcatctctacatattttcaaaagatcattttaatatgaggacataacctctcatgtaccaaatgcacattgatgcttacaaagatgaaaagttctcaaccattgtcaccaggatcgcagtcctgaggaagctcacgggtgtctgatgagtctcctccattcaggcccaggacagaaacctcagggagactcctggactagaacggcagggattctgatcacagccaatagagagcctgggccagggtcagtgtcctgtagaagctcacagggttcacatctgacccttctcctgaccctaaagccaatccgcatcagcactgatctggtgctccttttgctcccaatacatgttctttctttggagtgtttgttctcccttttttatttgcttttctttcttcctgaaaaagaaacacatggtctctatgctctacactccagggctcaaggcattttcttagaactcaggcaaggctcaggcttggctactccagcccacgtgggagaggctgatgggatttccttctctccccatattctcagggccctcctctgtgttgtgtgtagactcatctgggaatgcaattggccgttaatagtgaaggggataaactcatttgatcaaaatgggatgtggatgtggaattaaccctgttctatgcacactgtcagagtcatcttcttcagaagtagtgttagaaagagcttgtgaactttatcagaatcaaaatggatccacttgtgttaaaaccctaatgaatgaagctggggaaggccatgaaggagggttctaacacacatattcctgataagaagaactatcataaatagaccctgcacagccacaaccttttacacagaggccaccacagccttaaaagctttatttctccaagtaaatctgccccgcaactgcctattcaaccttacaccgctatctcaaaatagctgctgtcaccctcctcatttttccttaattctcttttttattattttttaaattatactttaagttctagggtacatgtgcacaaagtgcaggtttgttacatatgtatacatgtgccatgttggtttgctgcccccattaactcatcatttacattaggtatttctcctaatgctgtccatcccccttcccccaaccccactacaggccccggtgtgtgatgtttcccaccctgtgtccacatgttctccttaattctttatcttccttttcctacctgaatgtacccatacatattttaattgaaacgcacatcctagaaaaaatattattatactttagagtctctgtctgttattcaggttgacatgacaagctacagacggacatgccacttttctgtgagacatagaggatgacagtttttggagatgtctaggaatatccaatgtccataagatcagccatcaataagtgcagactggaggtcccagagagaggcgaagctgctgaatcatcgtggaatttcattttctccagttctgctctgatggaatcaggcccacccattttatcaatgacaatctacctaacctagagtcagctgatgacagtattaatatcatctattaagtaaagtcataactatatatatagtgagagagggagagagagagagacggagtctcgctctgtcacccagggtggagtgcaatgtcgtgatcttggctcactgcaacctctgtctccggagttcgagcagttctcctgtctcagcctcctcccagtatctgggaatacaggcacacaccaccatgtccggccaatttttgtatttttagtagagatggtgtttcaccacattggtcaggctggtctcaaactactgacctcaggtgacccacctgccttagcctcccaaagtgctgggattacaggggcaggccaccaagtccagctaatttttgtatttttagtagagaccaggtttcacgatattggtcaggctggtctcaaactcctgatctcagcctcccaaagtgctgggattaaagatgtgagctactgtgcccggccaacaccacctatattaatgttggattgaataactacaaagtctaccctaaccaagtgtaccatcaaacttaccattacccagaggaaagaatctttaacatgagatctatattcttaaatgttttaaggtgtaaaactgaccacagtacaatcacccaattatgattttgctaatgagttgtagaaactgcatgtatattttggatattaacactttttcagatgcacaccttataattatattctctcattctgtaggttgcaattttttccacactttgcggcatctttttgttgtgatgtagttctgcttgttcaattctgcttttattatctgtgactttaatttgaaatatagaaaatcatccttttttatatactttaaattttagagtacatgtgcacaacatgcaggtttgttacatatgtatacatgtgccatgttggtgtgctgcacccagtaacttgtcatttaacactaggtatatctcctaatgctatccctctcccctccccccaacccacaacaggccccggtgtgtgatgttccacttactgtgtccatgtgttctcattgttcaattcccacctatgagtgagaacatgcggtgtttggttttttgtccttgtgatagacttctgagaatgatgatttccagcttcatccatgtccctacaaagggcatgatctcatcattttttatggctgcatagtattccatggtgtatatgtgccacattttcctaatccagtctatcattgttggacatttgggttggttccaagtctttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgccttccacaatagttgaactagtttacagtcccaccaacagtgtaaaactgttcctatttctccacatcctctccagcacctgttgtttcctgactttttaatgattgccattctaactggtgtgagatggtatctcattgttgttttgatttgcatttctctgatgaccagtgatgatgagcattttttcacgtgtcttttggctgcataaatgtcttcttttgagaagtgcctgttcatatccttcgcccactttttgatggggttgtttgcttttttcttgtaaatttgtttgagttcattgtagattctggacattagccctttgtcagatgagtagattgcaaaaattttgtcctattctgtaggttgcctgttcactctgatggtagtttcttttgctgtgcagaagctctttggttcaacatactcaaatcaataaacaaaatccagcatataaacagaaccaatgacaaaaatcatatgattatctcaatagatgcagaaaaggcctttgacaaaattcaacaaccttcatgctaaaaactctcaaaaaattaggtattgatgggacgtatcttaaaataataagagctatctatgacaaacccacagccaatatcatactgaatggacaaaaactggaagcattccctttgaaaactggcacaagaaagggttgccctctctcaccactcctattcaacatagtgttggaagttctggccagggcaatgagacagtagaaggaaataaagggtattcaattaggaaaagaagaagtcatattgtccctgtttgcagatgacatgattttatatctagaaaaccccattgtctcagcccaaaatctccttaagctgataggcaacttcagcatagtctcaggatacaaaatcaatgtgcaaaaatcacaagcattcttacacaccaatcacagacaaacagccaaatcatgagtgaactcccattcacaagtgcttcaaagagaataaaatacctaggaatccaacttacaagggatgtgaaggacctcttcaaggagaactacaaaccactgctcaatgaaataaaagaggataaaaacaaatggaagaatattccatgctcatgggtaggaagaatcaatatcgtgaaaatggccatactgcccaaggtaatttatagattcaatgccatccccatcaagctaccaatgactttcttcacagaattggaaaaacctactttaaagttcatatggaatcaaaaagagcccgtattgccaagtcaatcctaagccaaaagaacaaagctggaggcatcacgctacctgatttcaaactataccacaacgctacagtaaccaaaacagcatggtaccggtaccaaaacagagatatagaccaatgaaacagaacagagccctcagaaataatgccgcctatctacaaccatatgatctttgacaaacctgacaaaaacaataaatggggaaaggattccctatttaataaatggtgctgggaaaactggctagccatatgtagaaagctgaaactggatcccttccttacaccttatacaaaaattaattcaagatggattaaagacttacgtgttagacctaaaaccataaaaaccctagaagaaaacctaggcaataccattcaggacataggcatgggcaaggacttcatgtctaaaacacgaaaatcaagggcaacaaaagcccaaattgacaaatgcgatctaatatgaaattcttaatgagttctatagttataagtacattatttctccttattaaaactaatcttttttgctgaatgggtggaagatggtggcttccctccaaaagaaaacatagttggttctgtaaagagttcacccatttcttccactataggcctgccctggcataatacaagctcccaacttaagaacttatgattttccatccatgggagaagccatcttttccatctattataaaaacagaagacacttcattaatatcactcccaaaataggctatgtcatatccagtgaggtaggatggctgacagtggtgagaatccaagtaattggtcaagcactgctatgtgtgaagaaacaccacagcatactctacactgtcactcatgatatggaattgttgcctcctcagcaatgtaactgagcccttaatatgtggctgggatgacaaagcaatgccagcctgcagagtggaacctgttcttccttctgggattagccaaaggccggtggcactcatggctgaccctactttccttacaactggacgaagcgaagcaactggatatgaacttctatcccaggatgtaactgtccaaagtgccttctctttatgtcaactggaaaagtgtgaaagacagacactattctcataaacggatatcctagttattccacccactagccagctcttccccccaggtggcagtcatagatttagaattgcaagtagaggccctggctaagcataccaccagtccctttaacaacacctaccataccatcatcattcttactgaagaaacctcacagatttgacaagtgacactatgaagctatatgaccctaggtattgcaactacagccaaaggtaacacttgtgtattaatgaaccctgaatgttgcatatatatacaagattagtcccacaatataactcaagctatgcaagcattagatacccatatttctgctagagatggatgccctctctcaggaccctgcgacagcatggtttagttgacttcctaacacatggaagactttcatatatagtagagctggtatactcttcattgctatcttcagttgctgtggattttattggtaccttgcactttaagtgagaatgtaatactgaccttctcaaaaactcctaggtccttgcaccataatgctccaacaaacacctactgtaattccggagactccagaatatttccaactccagtttaatggattcccttccaatatatacaagctatgccctttctaagaagtagccagattgactatgacacacgttttccatagaaacaaaatggaatttgacagtggggaatgatatacaggcagcttaatttcaaaatgcattttaaacttattttttgaggttttaatattattttcatactccttgaaacctgaaatttcacacttacattctaattgagacttaataacaaataaccagaacacatgaattgcctgtaatctctataccttgtattgtaagccacatttcaagtgtaaccttacttgtcagcacagtatgtttaccataggcataattgcttgtcctgactgtccagaaggcagggtggtattaagtatgcggcctctggagctgggaagtctggctttgtatactgtctctgccactgctaactgaaggacaatgggccagttacttcctgtaccccagttttgtcatatgtaaagtagggttgttgtaagaatgaaattagttaatatttagtacctaacaactagtaggcattacgtggtagctattcgtattgctatcgtcagagaacacacaggagtccattgttatttttaccctccccctccaaacaaaatgtgtaagacactagacatggtagctctgtaacggggttcgtcatgtattaaactgtgtacccaaatgatatgtcaaagtcctgacaaccagcacttcagaacacgtccttatttggaaatatggtagctggagatgttattagtgaagatgaggtcttacttgagcagggcaggccctcaatgtgggaagatgggtgtctttctaagtacaaggaaatttggacacagagacagagacatacagtgtgccatatgacagcagaggcaaagatcagagtggtgcagcagtaaaccaatgcatgtccaggattaccagtcacctccacaagtgaggaaagggcaaggaagaagtctcctgagtctcagagggagtgcagcccagctcacacttgattttggacttctagtctctagaactgtgagacaatacagtcctgtcatttttaagccacccagtttgtagtatttcattttggcagccctacgatattcatacagagttcttcacccaaaaggaagcactctttctcacaaacagtcaaagtcctggatgacggacaacctggagattgcaaacctccaaggaatcaaaggaggttctataaagtctaggagccccatctttcaaaggctgctcctcaagtccacacacacactttggaaggagaatcctgctcttggacatgggatccttagtgagccaactgccaataatccaacatcatcatgaattaaagatctctgacatttcctcgtcaccaacgggaattctgtcaagtagtaagtaaaacccttcttcaggaatctccacaccaaacagttctgcatggcttgggacgcctcaggaaacttataatcatggcagaagaaaaaggggaagcaaggcagtcatacatggtggcagaagagagaggttaaacttttcagtctctcttgggtgtaaagatacaatcttgaggcaaacagcagaatcaattttcttatgccttgaaattctccctttcaccataaatattcccttcacattaatctaactttatgtttgcatcgaactatgtgcctttttggaagttccggaagctaatttgagacagatagacaaagtcgggagaccctgatgcagaattccagaggtgacttcaatgttgctagttaacaacccaggcattgcccagatgatgccagcccaagatccaggtggactgggatgccagagagctgccagaacaagacgcacagacctggttctcagcccaaatcttgcatgcctttcttaccaactttcccttttttaaacccctgcctttccttcaaaattgaagtggttgcttgggatgggaatgcgttcacttcccctttaccattatggttaatacaataatttttgtaccagatctctctcttgttaattggatcctgcaggtggcagattccggaccagagtgacgttagaaactgaatgcacatactgggtggttcacagacacagtgttctgtgaagtttatgggtggattcctggggaagcctgcaagcctgttagtgattagcagaaccgcatccagctactgggatctgcacgccaggtgccgtgagcccctcaccatgttccctggtcccagctgcccgcggatggttcagccttgacaacgggctcggtgttctgggtggtgggagagcaagggggccccttgggcagcgtgctacagggctgtgaatccaggggcccacccggtgttccctgtggagtcactgagggaatgaggggcttctcagggcacagagctgtaacgcctttgtgcagtggtggctgaatacagtgacactgggcgcgtggtgagaagcggggcaaggtcagttcactggaccctccgccctgagcctcagatgagtcgggggtccccagacaggcccggcctctgccctgcggcggacactggagcctttgctgtggccgccaccgaggagccttgacctcaaaggagggggaacctctctacccacctcggaaacctgaagggagcggcggtctctcccagacaggatctcgccggcctccgcgtctccaggcccaaccctgtaccacataaaggaagtccgcgctgagctaccgggacacagcgccgttgggtgggcgggcgcggcgcggcgggaagcaccggggcagctgccacagagatgcgcggggactgtcgggaagtgggcggtccgggaggcgcggggctgatgggacgtgggcggtccggggacgcgcgggggatggcgggacgtcggcgatcccgagatgccagggggcagctgggacgtgggcggtctggagaggcgcgggggcagctgagatgcaggtggtccgggacgcgcgggggctggcgggttgtgggaggtccagggatgcgagggggcagctgggacgtgggagttccggggacgcgtggggtcgccaggaagcggggtctaggacttagatccgccttctcttcaggccatgcagccccgaagctccgaatcctgggatgactcctgtccatgttggaagggaccctgccagtcctggcaaggttcaacggccttagggcaagaaatgttagtagagtcctggaagacgatgtggggaacgggtagcggccaccggatggtgatcgttcttctacaagaccttgacatggatggggagaaacagagaagaaccttccaagtttgtcccactggacatgcccaccacactttaccagccctttctagaaggcctgtgcgtaacacatgaaaaagctgctctcgacctttccctgaccttttaaaagaaaacatttgctgcatctaatccgcctagatgtaaggaggttcccaaatgtatgacagagtcagacaattacatgtcttgtaagttaccatgtgcttgtcttttgttttccgttttttttcgtttttttgttttttgtttttgagacggagtctcactctgtcgcccaggctggagtgcagtggcaggatcttggctcactgcaacctctgcttcctgagtttcaacaattgtgctgcctcagcctcccgagtagcttggattacaagtgtgcaccaccacgcctggctaatttttgtagtttttagtagagatggggttttgccacgttggccaggctggtcttgaactcctgacctcaggtgagccacccaccttggcctctcaaagtgctgggattacaggtgtgagccaccgtgcctggccgtaagttaccgtgtgctttttaaacaaatcatagcaaaggggtgtcttctggaaatgacattttgaaatggagttactagaccacccctggaagggacacagtaaccacacgtccacgttcgttcagtgggtgagaggacatggaggggagacctgggcaggaagggaagagggttccatgccaggctgctcatatttaaaagacattttcattgtagggacatggatgaaattggaaaccatcattctcagtaaactatcgcaagaacaaaaaaccaaacaccgcatattctcactcataggtgggaattgaacaatgagatgacatggacacaggaaggggaatatcacactctggggactgtggtggggtggggggaggggggagggatagcattgggagatatacctaatgctagacgatgcgttagtgggtgcagcacaccagcatggcacatgtatacatatgtaactaacctgcacaatgtgcacatgtaccctaaaacttaaagtataattaaaaaaaaaaaagaaaaataaaagacattttcatatcgttgtcattgttttcttgtgtgcattttattcctcgctattgtatacatcattggaaattctaagtattcttttgaaatatctagtctttctagatgttctgaagtgcctgatgtatgttaaaattacaggtggtaaaataataaattttgtaaatgtctttttgttaaaattcatatgcagtgttttattttattttgatgttggtggggggtggggaggatggccaaatccctgcttgatcaacacacattgcgtttgtgctctggttcaggggaggagagaggaggagaaagtgcagacttccaggcctctgtgcgcaccgggaggagagattaatgatcatctcttctgtctgtgtgtttgttttatttatctatggatatcctgtgtataaaggatgaacaagtcctatttataacatctaatcttttcaggtgttaagttgccagcgtatgacggaagtagcattattaaacgaatgcagcttgtacatattgtgttaaaattcataaaaagccagtcttctgaaaagaacccttgggccctccctccgcagcctccggcgccagctgcaggaagacctggccaggggaaggcgggcggcagaagctgctgctggctgtggggaaggcggtggagcccaggcctccacaggctccccacaggctccccacaggctcgcgcggctctggttgctgggctccgcacgggccgcgtgggggcgcctgctgggagcgaggaggcgccatcctggctcgcctgctccaggaggacgctctgggcctgcgcagatgcagttctccaggatgggcgcgggcgctgggggcggcgctccttgggctgctgcgcctccactgagccgcctgggtgtgaggacctcgcgccggcgcctccgggaaggacgcggagccgccgcggccgatcccagggctgcagctgctgcccgacgcccgcgggaaggcccttccgccaccgcccgggggttcgaacttggagcagctgctgccagctgaggcgccagcggcgtcgggagctcctcagagtcagtgttttgtgctggattcggcatgtcctctgaaaactcgggaatttgtcactgaaatggtgacaggaggtgagaagtttttttagacgttgccttcgctggcctggcgcggggctcaggcctggaatcccagcactttgggaggctgaggcgggcggatcgcttgagctccggaggtggagaagctgccttcgtggtaactgtggtcttaagttcagctgagaacgataaatggcttttccttgaattggctgcttttgtgatttctctcaggctcatcttttgtcagttaaaaatccagtggtaggtgtagcttagagacgggaaatttttggttttgttttggctacacgtaagtgttggaaattattttcttttacgttccagtgtgagcaaatccagaaggatgtcagattaaacaccgaatttaacaaattcagccgggcacggtggctcacgcctgtaatcccagcactttgagaggccgaggcgggtggatgatgaggtcaggagtttgagaacagcctgaccaacatagtgaaactccgtctctactaaaaatacaaaaattagccgggcgtggttgtgcgcgcctgtaatcccagctactcaggaggctgaggcaggagaatcgccgagattgcgccactgcactcagcctgggcgacagagcgagacttcgtctcaaaaaaacaaaaaaaaatcaatcattggaatactgttgttcattacaattaatgaacgtttgatagacgcataaacgaactaaattcacaagtacatataagtaaaataagccaaaaaaaaaaaactacatcccgtatgatgacacttttatacattctacagaatagaaactaaagtgatatgaaggttgggagttgaatggagaaaaggtgagcgaaaagagggaggacggaggagttgcaagagaacaagagaaaatgttgagggtaattgatctgttttctatcttaataatggttatggttacatcaataatttctaaattgtacattttgtgtgttaattataattttatattattcaagctattacaaataaatacctgtataaatttcttagggacggtttaagggagatggataaatcacataaaaagtcagatatttctgaatgtacaatgaataacccttagctctatctttattttttggtaattctaaaatgcagcagatttttttaatgtttttattacaagaagggtttcttcaaaccacaccaggtgtgtgtaactctgggctaaagttggttaagggagcagtgggatccggtggagaggagcacaggcctcgatcctggagcccattcttgtcacatgtgagctcctggacacatctcatagctccctcatgcttctgcgtttacattctcatctgtaaatggaggaccaatgggcatctgcctctaacaatgtattttcatgtgttaagatgatgtatgttaagtgtttactatagcacaatcttttaataagaaattacatttttttccaaatactatcattgtcttcaagccccaccacccaccagaaaacttaatatgctctgtgccctgccctgtcctcagacatccagcccaagagacttttatatagtaggagatatgcaaatagttccctccctctgctgatgatgaaaaccagcccagccgtgaccgtgcagctctgggagacgagctcaagtgccaggattcccaagtgttttcacttggtgatcagaacttaacacagaggaatcaccatgttgtttgggctgagctgggctttcctttttactattttaagaggtgatacatgaagaactacagatattgttcgtgagtggatattagagaaacagtggatatgtgtggcagtttctgaccaggatgtctctgtgtttgcaggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggctgtgtgagagacatggtgaggggaaatcagtatgagcccagccagaaacctccctgcaggaaccctggggtggggggaaatcagctgcagggggcactcaggacccactgatcagaatcaaccccagaaggaggtgcacatggagattaggggctggattccttccaggatgtgggacttcaacttcttctgacagtttccccagggaaccgctctaagtttagaattctgtgtcatctctatgtatttaaaaaagatcattttaatgtgaggaactaactattctcacatgcacaaaatgcagattcacactcacagagatgaaaagtcctcaactgtggtcactaggatcagagtcctgaggaatctcaggcgttcctggtgagtcttctccaatcagacccaggacagacacctcagtgagattccatgactagaacaggctttatggattttaaaaaaaatagactgagccagggtcagtgtcatgtagaacctcacaggtttcacatctgacccttctcctgacactaaagtgtgcaaatcagcatcaatactgatctggtgctgcttttgctcccaatctgtgttctttcttgagttgtccctttttcatttgcttttcctgctccctgaaaaaagaaagatgttgtctctgtggtctaaattccagggctcaagcccttttcttggagctcaggtgggtctcaggttgtggctcctgcagccacgctggggaggctgatgggactttcttctctcccattgctcagggccctccactatattgtgtggagactcatctcagaatagatgtggccagtgggagctgaaggggacaagcttgtttggtcaaaatgagatacaaatatggaattcaccctgtgctgtacaaactgtcacagagtcactttctgaaacaatagtgttagaaagaacttgagaaagttgtcagaatcaaaattgggtcacttgtgttaaaactctgctgaatgaagctgggaaaggccgtgacggaatgttctcatgctcatatccctgataccaagaactatcgtaaatagactcttaaaaccacaatcttgcacaaaggtgcccacaaccttaaaagaattacttctctgagtaatcttcccagcagctctctgtgtaagattggactgatgccacccttgttattgattcttctatcccggagaagttgtctcaaaacagcttatgtaaccctcctcatttttctttaaacctttatctttctttacctgcctgagtgaacccatgcatgttcccattgcaatgtccatcttcaaataattatcattttactttagagtctctttttgtctgttattcagatttgacaagctgcagatggacacatcacgtttctgtaagacttaggggatgacagttttgaggcatggctggggaagtacaatgtccataagattgaccctcaataagtgcaggctgtaagtctcagagctgaagctgctgaatcaccatagaatttcatctttagttctgctctgatggaatcaggcccacctgtgtaatgaatgacactctacctaacctagagtcaactgatgacaggttaaatatctagacagcaaatttgcaacaccacttagattagtgtttgaataactacaaagtatagccgagccaagtatatcgtaaagcagactattatacatggagaatctttaacatgacatctacaattcttaattttttttacgtataaaactgatggttttacaatcaggctgtcatgattttgctaatgagttgtagaagttacatgtatgttttaaatattaacagttttttcagatgcctggtttgcaactatattctcccattctgtagatttggaattttttccatgctttgcaaaatctttatattttgatgtagttccagtccttcaattctgcttttgttgtctgtgcttttaatcttaaatttaggaaatcattgctaaccttttggtgggagagaattttacaattgcaggctatacatttaactgtttaacccatctagagttgattttttgtgtttattctaacctaatattcttaactatttgcaagtgaaaacccagtttgtttaacaccctctttaggggagagtatgatttagccgttgtgtagaaaatgttataaatcactttgccttcatattggttctcaacttgaaaatgagtttgccatcaatacgtgggtttatttctgagctctctatatgtatttatgccagtaccatcctgttttgattatgtttgtaattaattttgaagtctgagagtaaaatgcctccaagtttattcttgcccttttgcagatattagacaaaatattttaacatttcaccatgaagtatgataacagctatggcttttcataatgaattttattgtgtttaggttattttcttgtatttctattttgggtagagtttttatggtgaaaccttgaatttttttaatgttattttctgtctgagaagttaatgggaccttcttcgtatttaatttggcataccaaatgtattgatttgaggattttgaatcatctgtgcatctcaaaaataaatttgagttggtcatggtgtatgatccttctaaagtcctgtggaacttagttgactattatttggtgtgtggagggggctcatttatgtctactaggaatattggtctgtagtttacttttttgtgaccttgtctattactgaaaatacggtaatttgggccttatagaaagactggaaggttggcatctcaccaatttttgaaaaagttagagaatggttggcattacttctttaaatgttgagagtcctttttttacttaacatgtgacctatcatggagaatatttagtctttgcttcggaagcatacatattacactgctcttggttggaaggttctgtagatgtctattaggtcaatttgttcaatagtgttgttcaagtccactgtcttcttaagaattctcttaatgatgttctatccatcattgaaagtgaggtgctaaagtcttctcctaatttttattattttctatttatctctccatatctcttaaggtttgcttaatgcagttatatttatttttgtacaaatatgtaaaaaataaatgaaataataattgctaagtaattttaatggcaaaatcacataataagaaattatattttcccaaatgctgtcattgacactaagctcctccaggaatctcacatctgctctggacacggctctcctggtgtcctaccccagagcttgctatagaggaggagacatgcaaatagggccctcactgtcctgatgaaaaccagccttgcctgcgtctacgggagaagagccccagtccagaagtaccaggggtttccatttggtggtcaggtctctgaacacagaggactcactatggagtttgggctgagctgggttttccttgttgctaatgtaaaaggtgactcatggagaactagagatattgagtgtgagtggacacaagtgagagaaacagtggatatgtgtggcaggttctgaccagggtgtctgtgtgtgtttgcaggtgtccagtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactgtggtggcattgtgtgcatcccttgtttaggtacatgcagagatgctgctttggtgtgttcaggggctcctgttttggggacaccaattttggagtttgcagtatccttgagtccagtacgttcatggtggcattgggtctggggtgtgcagtggcaatgagtccaggatacatgcagctgatgccgtatcttgtgaggacaagaacaactacaaaacgatcctattaataaataggcaaatgacttgaatacacatttttcaaaaaatacatacaaatgacatatagatatataaaatgttaaatatgagtaataatttttaaaattcaaatgtaatctacaataaattatcaccccatacctgttagaatagctatttttaaagaagatgaaagataaccagtattggggcagaagtggagtaaagggagcctatatatattgttactgaaaatgtcaattagtacagacattatggagaatactatggaggttcctcaaaaaataaaaatagaactaccatagtttccaacaagcccactactggctatgtatccacaggaagtgcaatcagtatgtcaaagagacatctgtgcccccacgttcattgcaggaatatttatgatagtaatgatgtgggaacatcctaaattaccataaatggatgaattactaaagaaaatgtagtatgtacccaatggagtaatgttcatcctaaaataagaagggaatcctgcatttgcaacagcaggcatgactctagaggaccatatgtgaagttccacaggcaggcgcagaagacgagtaattcgcgatttcactgtagtttgtttaaatggtagactcacagaagtagagtggagtgttggttaccaggggctggaggggtggactggaaaaggcgagattttggtcaaagggtgaaatgttccagttagacagaaggagaaagttacagtgttctaatgcacaagatggaaaatatggctaataatgcattatatatttcaaaatggctaaaaatgcaaatgttaaaaattttctcactaagaaatgatacagcctgggcgcggtggctcacacctgtaatcccggcactttgggaggctgaggcgggcgaatcacaaggtttggagttcaagaccagcctggccagatggcaaaaccccgtctccactaaaaacacaaaaaatagccaggtgtggtggcacgcggttgtaatgccagctactcgggaggctgatgcaggagaattgcttgaacccgggagacagaggttgcagtgagctgagatcatgccactgcactccagcctgggtgacagtgagactccaactcaaaaaaaaaaaaaaagaatgaaatgatagctgtgtgaggtgatggatatgtcaaatagcttgattaacaattccataatatatacatgtatcatagcatgtgtgaggtgacctgtatgaaggtgaagtgacctgggggctgtgtaagattacctgggggtatgtgtgaggtgaacacggcacatatgaggtgaccagagacacatgtgaggggacatgggagatatgtcgggtaagccagggggatttgtgaggtgacacagagcaagtgtgaggtgacgtggatgcatgtaaggtgatttggggcacatgtgaggtgacgtgggggatatgtgtgagctgacctcgggtgagtgtgaggtgatccaggatggatgtgaggtgacctgggggtgtgtgtgaggtgacttgggcacatgtcaggtgacatcggggattggtggtgatgtgggtgtgtgtgaggtgacctaaggaggtatgaggtcacctggggcatctgtggggacctggaaatgtgtgaggtgggtacaggtgaagtcacctagggcacatgtgaggtgacctgtggaatgtgtatggtgacctgggaccgtttgaggtgacatggggaatgcgtgaggtgacctggggcatgtgtgaggtgacaaagggcatgtgtgcagtgacctgggtgcatgtgaggtgacctggtgcatgtgttaggttacctgggggatgtgtgaggtgaacaggggcaggtgtgaagtgcctgaggaatgtgtgaggtgaactggtgcatgtatgtggtgacctgggggatttacgaggtgacctgcgggatgtgtgaggtgaccttgggtgagcgtgaggtgacctgacgtatgtatgaggtgaccagggtgtgtctgaggtgatgtggggtatatgtgcggtgacctggtggatgtgtgaggtgacctgcaggatgtgtaaggtgacactggggatgtgtgaggtgactcagggcacatgtgaggtgaaattggggatgcgtgaggtgattcagggcatatgtgaggtgaccttggggatgtgtgaggtcaccttgggtgagtgtgtggtcatctgggatatttcccaacttcgtaaggaaagcctgcaacaacacatggcattagaagcttcacactctagcaccattaatgcgtacatcctcaaggaactctaaatgttttgaggttagcttaaatgccatggagcggcaccttccccaggcacactcatatatgcatcctgggtctccctgccaagctatatctcctcaaatttacagtttatgtttgctctgtgacatcaactctgatatgttcaagtgtgtttttttttctttatttgtagttgttcaggcttgttgtttcactctcattactctgggctcagtcctctcctcaggtgtcccacttcagagctcgctgtgaaataggagacatgcaaatagggccccccctttcctgataaaaagcagcccagtcctgaccctgcagccctgggagagaagcaccagccctgggattctcaggtgtttccactttgtcatcagcaacaaacaaattaccatggaatttgggctgagctgggtttttcttgctgctattttaaaaggtgattcatgaagaactaaggatattgagtgagtggacatgagtgagagaaacagtggatttgtgtggcagtttctgaccagggtgtctctgtgtttgcaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaacactgtgagaggtcggaagtgtgagcccagacacaaacctcctgcaggaacgttgggggaaatcagctgcagggggcgctcaggacccactcatcagagtcaaccccagagcaggtgcacatggaggctggggtttgtttcctgtcaggatttgggacttcctctgcttctgacagtttctctagggaaactctttaattttagatttctgtgcccaccaatgtcatctctacatttttttaatcattgtatatgaggactcgttctcacatgcacaatatgtatattgccacctatgggaatgaaaggtcctcaaccatggtcaccagcatcagagtcgtgaggaagctcaggggtgcctggtgagtcttctccagtcagactcaggacagtaacctcaaggggattcccttgtgagaactcacacattttcatgagaacagcaccaggagtcagttctaaaccattcatgaaagacccactccatgacccagtcacctcccaccaggtcaccccttcacaactggggattataatacaacatgagatttggggcaggacacaaatccaaaccatatcagatacacattgtgaaatacgcatggtggtcaggtaatttgtatttctatcacctcacagcgctaccattttattattttttttaatttactgcatgagtgagtgtctgatgagaacacctaagatctaccctttcagcaacaatcatttttacaatacagtattaactataggaccattgctgtacgttagatctccagaactcatccaacctgcacaactgaaactctgtacaatttaacacacatcacccaatttccctcacctcccaggtcctgggacccactattctactctctgctttcaagagcttgaatattttagatcccacatgtaaatgagatcatgcagcatttgtctttctgcatctggcttattcaactcagcatcatgtcctccaggcccatccgtgttgttgcaaatgtcagaatttccctcttttcaaagccaaacaaaatacagatgtatgtatacacattttctttatacattcatccatttacagtcattaaattattttacaaatctacactattattaataatcttgcaatgaacatgtctttggcaaagtaattttatttcctttgcatatataacaagaagtgggatcaccagattatatgatagctttatttttaacttatcaagtaaccaatcctaccacaggatatttccctttcccccacattcttgccaacatttgtcatctgttacatttctgataatagccatattaactagtgtgagttgatattgcattgtgcttctcatttgaattcctctgataattaggaatgttgagaactttttcgttttctgtttgccatgcatgtatcttctgaaaaaaattatccaggtttttgcccttttttatcagttcatttgttatttgctgttgaggtgtatgggttatttatacatttggacagaacttcttgtcagatccataattgcacatagtttttcctgtgctttgttattaaattcaaagaaatcagttccgaattaatggcaggaattttttttgctccatgtcatttatgagtttatggcttcaggtattatgtccatttttagttgattttttttttttttgggagacggagtcttgctctgtagcccaggctggagtgcagtggcgcgatctcggctcactgcaagctccgcctcccgagttcacgccattctcctgcctcagcctccgagtagctgggactacaggcgctggccaccgcgcctagctaatttttttttgtatttttagtagagacggggtttcactgtggtctccatctcctgacctcgtgatccgcccgcctcggcctcccaaagtgctgggattacaggcgtgagccaccgcgcgcggcctattagttgatttttttatatggagttagagaaggcctaattttatttcttttgcatatgaatgccagttttacaccattattgaaaagactgtcctttctctactgtgtgctcttggcacacaaaatcaggagagacataatgacaaaaaaaatatgagatcaatagtcctgatgaacatagacctgaaagtcctcaacaaaataccatcaaattgaatccagaagcactttaaaatgtgatacatcatggtcaggtgggctttacccctgggatgcaaggctcgttcaatatccacagtaactctgattcacaatgtaaacagaataaaagcaaaaagcatatgattatgtcaatagatgctgagaaagcttccgataggatctaacatctactcatgataaaaaccctcaacagactagacatcaaagaaacatacttcagaataagagccatctacaacaaacccacagttaacatcatactaaatgagccaattaaaacacttatctttataaatgacccagtctcgggtgtttctttacagtgcgagaatggactaagacagcatccaaataggaaaggaagtcaatccgtccatcttcactgatgatataattctatatctagaaaatcctaaaaactctgccaaaataattctagaataaacaactttagtaaagtgtcaggatacaaaatcaatggacaaaaattaccagcatttctataagccaaccacatccgagctgagagtataatcaagaacacaatcctattcgacttacagtatccacaaagaaaatgaaatgcccgggaatacagataacaaagtgaaagatccctacaaggagaactatgaaacacagcatacataaatcataaatgatacaaataaatgggaaaacatttcatgctcatggattggaagaatcaatattgtaaacattgtcataatgcccaaaggaattcagattcaatgctatttacataaaactatcatcatcattcttcacagaatcagaaaaaaatctattctaaaatttatatggaaccaaaaaagaccctgaatatccaaagcaatcctaaggaaaaagaataatgccagaggcatcatgatactgaccttaaactacaccataacgtcttgctaacaaaaacagcctgtactggtacgaaagcagacctgcaggaaaaaaaatagatcaaaatagaagacagaaataaagttgcacacctgcaaccctttgatctttgacaaagctgacaaaaacaagcaatggaaaaaaaaaactctgtgttcagtaaatggttctgggataactggattctggcaggtatgcaaaatgcaagagtgaaggagcctgtgcagcttctacctagatttcagatgtgtagagagccctgcatgcccaggaagaagcctgctgcaggagtggatccaccacagaaagcctctactagagcagtgccaaagatggggaaagatggagttggagcccccattcagagtccccactagggcacttcatagtaaagttgtgggaatgtggccacaaccctcaagaccccagaatggtagagctacgggcagcttgcaccctcagcctagaaaagcttccagcacttgactctcacttgtgaaggcagccccgtggtctgtgcctagcaaacctatagggattggctgcctgaggttttggggacccaatccttgttccagtgtgccctggttgaagtacataaagtcaagagagattattttgtagcgttaggatttaatatctgcagtgctgggttttatatgtgtgtggggcctgttggttgttcctttggccaatttatccctttgggattggaattatttacccaatgcctgcatcatcattgcaccttggaagtaaacaacttttattttttaaatttgcaagctcacagctggagggacattgccttaagactcagatgagactttgaaaatttgagttggacgttgatgaagttaagattttgggcactattgaaaaaaggtgattatattttgcaatgtaagaagaatatgagaactttgggtccgagagtgcaatgatataatttaggggttttcccctccaaatatcatggtgaaatgtgacccacaatgttggaggtggggccaactgggtggtttgggtcatggggaaagatttttcaggactggcttggcatccaccccatggtaattagtgaattcttgctgtattagctactgtgagatctgattgttcaaaagagtcttgcaatcctgctaccctctcatgtaacccctcctcacaatatgacacagccttctccccctttgccttccaccatgactgtaagcttcctgaggccctcacaagaagcagatgctggtgccatgcttctcacacaacctgcagatctgtaagccaaataagcctcttgtctttgtaaatcacttggcctcaggtattaatttatagcagtgtaaaatagactaatacactgcccaaagcaatatacagagtccatgcaatttctatcaagtaactaattaattatgtatttttaaaaatcctaaaatttatatagaaccgaaaaacactctgaatagcaaaagcagtcctaaccaaaacgaacaaagctggaagtaccacattccctgacttcaaattacacagcacaaagataataagaaaggcagcatggtagtggtagaaaaaaaatcaagagcccagatatatagccaaatatctacaaccaacagttctttgacaaaactgacaaaaatatacactggagaaacaaccctctattcaataagtagtgctgggagaattagatagccttatgtagaagaataaaatgagacttctgtatcatcatagacacaaattaactgtgaatatggattcaatgtttataaactcataaaaatacttgaaaaaatctaaaaataatcctctggacattggcctaagcaaataaaatatgactaagacttcaaaagcaaatgcaatgaaaacaaaattagacaaacaggattaattgaaccaaagatcatctacacatcaaaagaaagaaccaatatggtgaacagacaacctgtgaatggtaaaaaaaaaaaatgtgcagtctattcatcaaatatatagaatctacaagtaactcaaataagtcaactagaaataacaacttcataaaagagtgagcaaaaacgagatatttctcaaaagaagacatacaagtgttcaacagaaataaaacatgctcagcatcacaaatcatctgataaatgtaaattacagacaacatgatatagcatcttccaccagtcagaatggctattaaaaataaaacagatgtttgcagagaagcataggaaaaataatgctttttatatgcttgatgagaatacaaattggtacaacctctatgaaaaacaatacagaaatttctcaaagaactaaaattagaattaccatttgacccagtaacccctcctggtgggtatgtttctcccaaaaggaaacttctatataagaaaaagtcacctgcattcctatttttattgcaacactattttcaatagaaaagtcaagtaatctctctaagtgtcaatcagtggatgattaaataaaatatgatagatgtaaatcatggaatactatgcagccataaaaaatgaaattgtgtctttcacagcaacatgaatagagttgaaggacatttcctaaataaaataactcaaattctcttttataattggaaagcaaacaatgggtacacatgtacatagagaaaaacaatagacactgggtactgcaaaagaaggcaaggtgagaggaaagtgagggttaaaaaatcagctattggctccaatgttcactatggggtaacagttacatcagaagcacaaacctcacctttatgaaatatattcatgttacaactctgcacatgtgcaccctgattctatgaaaataaaaacagaaaacatgaacagaattgttagactgctagctagattgaccaacaaacaagaaaaatgcaaaagtagcaattctttgttttgtaaccctttctcattttctggtaccataagaaattgtagactatcgtcctatattcttttctgaagtgctaccattagccatttctcaaagaaattctggttccttttttcttttattttctttcattttttttagacagagtctgcaacgtccacctcccaagttcaagcgattctcctgtctcagcctcccaagtagctgggattacagacgtgcaacaccacacctggctaatttttgtatttttagtagagatgaggttttgctatattggccaggctggtcttgaactcctgacctcaaatgatctgcccacctcagtctcctaaagtgttggaattatgggtgtgagccactgcacccagccgctggttccttttacagaagaatagtattaaaaactcatatcttgattcttgatgtactttttgttaatttcttgtagaacatctcaagtaatcaatacaggaagtatttgttgtgtattaacccatatatatatatacccacatctaaacggtttttatttatgttcctatattatgctaaacttgcaaatccactgagataccctaagttaataccacatgaatgattttcaccttccttctatgcctttccctaacctagcactccaaccgtggggaaccccctcccaccacacaccatccattccctttgtagtccatttccaggattcctgtagagtggaacccgattgtgtaagttgtgctcttttgtggaacatcatcaagtggagtccagtgctgacgtgcagtttcttttttctttaatcttatggactacactatttctgaacctacttagtacctcttttgatttcatacattagtataatggcataagatattttctatatagtctgcattccatcctggaattcctaatcacctatttttttaaaatttcttgtggattaagattgtattagtcagtgtcccctagagggacagaacaagtaagatacacatacacacacacacacacacggagtttattaaggagtattaactcacactatcacaaggtccacaataagccatttgcaagctgaggagcaaacaagccagtccaagtcccaaagctgaagaacttggaatccgatgtttgagatgaggaagcatccagcaggggagaaagatgtaggctggaaggcgaagccagtctaatcttttcatgttcttctgtttactttttattctggccacacttgcagctgattagattgtgccacccagattaagggtgtatctgcctttttcagcccactggctcaaaggttaatctccttcggcgacaccgacacagacacacccgggatcaatactctgcatccttcagtgagatcaagttggcactcagtatttagcattacaagtccaccctttgtcaacttgaacccatacacatctcctgagattatacataatcttcaaataaagacaagaataaagtcataattatgcctaataatacaattattcttcttacaactggaaacacaccaatccccaatccaaatggtactacatatgctccactccctcaaggacacagccaggatcatctgatgacttggtgtctagatggcttcagcacttttaattttacctccaatgttagactccactttatcaatgcagatgtagcagaatattttaagacattgatatgctgaaaaattcaacagttcataaaagttgccttcccaccacagccagtggttactactgaataaggacctgccatcctctagggagaagctataatggatggggtgcactgttggtggttatggaaatcgatccatcgtggcaaatggcagcatctttctttgataacattatattctattgtgcatatataccacattgtctttattcatttgtctatctactgacagattttttccatatgtttgctgttattaatagtgtttcaataaacataggatgcagatatcttcacaaggtggtaatttcatctcctttggatatactcccagaaacaggattcctggtcatacaatatttctggctttaattcatttaggagcctttatactgctttccataattgtgaaaatgtagaatggtatagccattatgaaaaacagtttcagttttgaggtatgatctgtaaacaaataatgtttgttatggctctcaatgagagtttctactaaatatgatggaaggtcaggaaggtctctcaccttaaagcagggatggattatgcctcttatttcctaaaagcaaaagattggaagcatgcatgatggaggtggttggcaggtttcaggatgatctcataagaggagaatctgttggataaaactgttgggttttcagtcatagacacacctacactcaatatgaaatgatgaaatcaagtgaggatctagaatgtgttcgcttgaagcaacagcatattctcaaaggcacctattgctccatcacaagggtgatgaacttttgaaaccagtaaagtgtgagagcacagtaagtgataaagttatcacatttacatgaagtttgtttaatgtgccaagggctcgcacagattaatcataaataaacacaatgtattttagcatacatagatgtctagagaagaatcttcttagagaaacttcttcaggttacagaaatctgtgtaagttgtagatctaatggagaagtgtctatgaatactggtctgtttttgaagtatggaaagatgatctcttttggagtaggcttgcgattgtgttgatttcttaattgtttcttgagttgtaacaaaagaaccaaaaaaatgactaaccggagtttcatggctgtgttgataaaaatttttcataagctttctgtcaattatttgagaccagatttcctgatttttttctccaatagatacatgttcacaagatctcaggaaaccacctctcaggtgctttagtttaaaagactagcttcctagaaaaagaagattctgtctaaccatgacaagttggtttcatctgcaaaccatcaagtttgagacctcattgtcaagaatcataaaaattttaactccaatgtactgaaaatcataaatctcgaatttaatgttgataggcattgacaaaatggttcattcttggatgcgtcctatgttgctggctcaacatatcagttaattgagaatcctcacttagctccctctgtttgtagcactgagttgattgtcaatcttcagagtcatccgttgaaggagagtcctgaggttcatgggattcttgtagacactcaggggaacaaaagaaagaaacagaattgagggctgccagccatttccacatcactaggaataattaccatctaagtataaaggtctgcatcattcagaacaccctgcatgacaggctgatgcaaaaaatccaaccctacagaggctccacagcaacctttacagttctttccgggaagaaataatctccaagttaagtgagtcagtaaagctgctctgagctacagtaaaaattggattgggcccgatttgtctgagttcagtgtaattattatactcagctgctgccccaatatagactgaggatggataatttaaatgagcctggctatgtggtttgttatatatctgaactaaataaacataaagggcctgtctggactagcgtgagggtgagagatcctgggagccccagccccccatactcttatctcccttcctccaggaacctctaggttctcagggtgagaatccacaagatccattcatggctctattaccaggagaccaaaatctctgaccttgttcatacagacaaacaggcgaaggacatttttagatccttatctatgtggcgaaaggcaatctatccccattacaagccttaccagcaaccttcctttgtcatgaaaatgggtaaaattagccaataggattacatttaagaaaattttcctgtgatgttccagccagaaaacagcaaaaatcagcttcacacctggagacttcttgcatcggtcacagcccagagaaagaagatcaccatagcattaaaatgcaactgtaagaacatgtaatgcttccatgttccacgcattacgtctcaccagtttagtcaatatggattaaatatgagagtgtggcaattcgcaaactctatctgaggaggaaaatcggataaaaaatgttatgaaaaataaagcaatttgaagcctctgacttcagcaacttcaccactaatgaaatgatgtaaccctcattggcctcaaatttagttttcacggggcatctgcagggttccaaagtgagaccaggtgaattcaatgtgcatgcacttcccaagtgtccacttgtattctgtttctttacttctgtttacagaaagtagacacatattcagtcttagtaccagtgtagggagcgctttccatgagatggataccagaaaaaaatggcaaacatgggatccgttaatataaaaattagccacgatgtatatatatatatgtgtgtgtgtgtgtgtgtgtgtgtgtacacacgcgcgcgcatgtgtgagttgaatagcagagttggagtgggtttctatccacatgtacctgcacctgcaggtattctcaggtgccataatcaactgtaggaccctaaaggaaataagagtctcccctcaacccctgaagagtgtttgggttcaccgtgtgtccaatgattctgtgcctcttgagctccaggaaagggctccctggtgatgcatgagatcttttcttggagtctctctgcagagttcactgggtttcctaaaggcaattcactatttcaaaagatggtgtgaggagcatgtggtgtccctaaaggagaattctgagccagggcacaaccactttatactgagctggatacactggtaggaatatactctgtcagctcagatagaaacctccctgcatggttggggctgggctgcagggggcgctccggatacacccagcacaggctcccgccccagagcaggtgcacaggaggctggggagaggttcctcccagggcctgggacttcctttaaaaatatctaaaataagtatttcacaaagactgctgaagtttgtataaatatctattcaattgtgagcatttatcaaactggatgttgtaatgagaaccacttttacaatggggatttcaaactctgctggaggtcaggaagagatcctttcttataaataaatgcaatttttggataaacacagtcattccctaaataacgcattcacatattatggtctagaaatgatgcaagttgaccctgagacagtcaaatgtggtttcaaagtgaggtgctgtccttgaggagcttgttctccagtgggggaagctctgtcaacacagagttcagggatgtgtaggggacacatggcctctaacaggattacggcttgaaccctcagcttctacagttgtgtcacccatgtgtctgtttctcatactgggtcaggaattgggctattaaatagcatccttcatgaatatgcaattaactgaggtgactatagtatctccgttccctgagagcctcacccaacaaccacacccctcctctggagaagcccctagatcacagctcctcaccatggactggacctgaaggatcctcttcttgatggcagcagcaacaggtaaggggctccccagtctcagggctgaggaagaaaccaggccagtcatgtgagacttcacccactcttgtgtccactccacaggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgcgaagtacacagtgtggaaacccacatcccgagagtttcagaaagcctgaggaaggaggcagctgtgctgagctgaggcagtggtacagcagttttctgaacttccatagtatctcattttgcattgagttccgctttaatattagccaagaatatgggatagacgggtgctcctaagagatccttaacttgcccattttgatgggttttcccaaagacgtgagaagccacttttttcgcaaagcatcccaaagccatgccctgctccagaaacacgtgtatccatttcctggtctttgattaactgacaaactctcatcagcgcacctgggctaatttcacatcaggtagaaatatgtgctttaaagcaaggctaacgttgtaatagcaattcctgcttaataaccttcagcattgttgttgtgtgctccatcaactaattacgttagttcaaggttctcaatgggagtttctaataaatataagggatgtatagaagttcccctaattaaaacaattgtgaagacaacctcagtgttcaaccatatttcaacccttcaccacaaaggaactttcatctctcctggaagttgggttcattttcaaattagtttttttattttaatatctcaagattattgtatgtgactattttagcagaaagtgaattatgggaacttgaactaaccaactgaaaatacattcagaactaattaaacaagatgccagaatgtgattggctccaggcattttaaattcaacaggttatgtaaccaggctttaaatttgcacatcttcgtgttaccttcatgacacagtcaactcccattatgtaagaaatggtgagtgcattcccaagggtcttgcacagttataaaaatagacttgatgaggtgaggagttgtttaaattcccctctgaagaagcagcatcaacccaacaaaccactctcttccctctgtgactagagctctgtcacaggccacatggacctaaatccttgatggagattacaggactacgtaaattggactgatcgtttttatgctgttaaattaataggtgagtctgcactccagcctgggcaacagaataatcttgtctgtaaaatacaaaagaaagataaattaatagatactgactttgacatttcggataataatattttcataaaccgaatttaattatacccacattgttacctacaccttcactgaaaagttcctagttatgttgagttccatcaacactccacatgttcaaatctggacatccaagagagtctagagaataaaacgcaatgagggcagtgaaacttgcgtatattcagcacctcttaactcaggaggactcaatacaccctggaacactctgcttttctgaatggctcacaatgactccagctcactctccaacctcctcaaacatctggcctctgtttgccctaagttcacgctctgctcttagtctatgttctgaagtctttgtagaggtgaaaatgagctgtcagatggatcttccttctcactgcaacatggaatttgctatttcacttaatgaccactctttccacaatggttgatttcttttggcctgttcattactggtgattttcaagggaatctcagttgaatctttactgttttgcattttgtctccatgacaatgttgggaagtttttcttctagcagcataacatgatctagtgacctgacacatttgcagcaaacaatacctacaaattcagaagctctttggttttctttccacgaaatataattcttgctcttctgtgtatgagcacatcctagcatccctgtacacacccacgtagatgtctacacgccgatgaaatattccctgtaaataaaaaaagtatctcagtttctctcaatgttcataattctcctgagggtgaggaaggtacttctgggtctgctcaaacaaatggcccagagaccacctggtaggtaggtaaggagctcacctcgctctggatattgagtctgtctctttccctctgtcgtctcatagaaggccagcccacttgttcagctcctaagaagagagcccaggtttatccagattatacaacacaaccagcttctgatgactctcctgttacaacatccatggagatattttgtgtattatataattcaccaaactaatgtgaaatgcccaagttgcaatactgcacaccctagggtatgttcttgcaattcagcggaggagaaattctttcagagacagatggatctgaattggtaaatatgtgggtacgaattctgggcttgagtgtcattgtccagccatgtttcacaggtgtgacctgtcagggaagaaccagagttccttgttctctcagagggtagagctcacagaggtcctctctggttcccaggaaaggtaatttcactaatcttggtgatgagactatcctccagtgctgatgtactatagagttttcatctgaagctgtcactgctatccccaatgtacatcttttcacacagaaatgtttagaggtcaggccatattctcagggttacacattgagaaggatggagatatattctactaccttctcctgagatctcacacacaatctcaaatttcaaaaggtctcagaagggcagctctcaggtactatttaaaaataacccacttcctgggacaggtagcatccttctaaccatgatggatgttctgaactacagtacacattgcatggatccaggtttgtctcaattcactgtgattattacactcagcagctgtttcaatatgtctgaaggggtaaatgacaatttaggtgacctgggtgtatggttggtgttatatgaatctttaaatgtagaacagtattaactgtattccaaaatctgtctttgatccatgatcacacttgtctcccagaccagctccttcagcacatttcctacctggaagaagaggactctgggtttggtgaggggaggccacaggaagagaactgagttctcagagggcacagccagcatacacctcccagggtgagcccaaaagactggggcctccctcatccctttttacctatccatacaaaggcaccacccacatgcaaatcctcacttaggcacccacaggaaatgactacacatttccttaaattcagggtccagctcacatgggaagtgctttctgagagtcatggacctcctgcacaagaacatgaaacacctgtggttcttcctcctcctggtggcagctcccagatgtgagtgtctcaggaatgcggatatgaagatatgagatgctgcctctgatcccagggctcactgtgggtttctctgttcacaggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcacagtgaggggaggtgagtgtgagcccagacaaaaacctccctgcaggtaggcagagggggcgggcgcaggtactgctcaagaccagcaggtggcgcgcggcgcccacagatcccgaggccgggtccggagcaggtgcaaggagggcggggcttcctcaacagctcagtggtctgtctcctcgccagcacctcagatgtccccaggactctctttctttattatctgtggttctgcttcctcacatccttgtggcagggaagaaaggaggaagacaatttttctgtttactgttgaggtttcaccaattactagaaactttcctacaagttcctgcatgactcattttgccatatatggattctcaccatctcttgatttgtttcatcaatcgaattgtgccctatttgaaattaacttactgaaaccttaaatccaatggatctatactggaattttaatgatgtaattgaggttaaatgtggtcaaagtgtgagaccctaatgcaataaaccgttgtctttataagaagaggaagagacaccagagacctctcacttttcacgtgcacacagagaagaggccatgtggagacgtagtgcactagaaggtggccctgtgcaagccaggaagaagccatactaagaaccaattttgccagctccttgatcttcgacattcagactgtagaattgtaagaaaatcaatatttgttgtttaagccacccaatcctgttgtcttcttacgaagacccaaactgactaataccacctaactctgttagctctgtctcctggagggagaagcagccccctgaggctgggcactgcatctctcagatttccacgtgaagtaggcaaaaatagtagttctcatataaaaatgtgtcatggctctgttggccatttttgagcatggtctctgaaaccagccctggtgtgtgtgtgtaacaaatgtcccttatcttttatttggacataacaaatagacgataggtaccagctggatggagattggccactgatcatcttctgttctccttagtatgtcacagaaaaccacaccaacatcaccagcatcactgtttttcttctaccacctcaaacggactacagaaatgatccctgcagtatggtctatttcttcggctttcgaaatttgcactgaatctcttcctaaatggggagctacatggggtctgagttttgttcctttcttcccagtcttccccaagtaccaaggacagaatagacttaaaatttggccatcaatgcccccaaacaccacatcactttctaaaatccacatcctgcatccatccttctctggacacccctcatcaggctacccaggaatggccagaatctggtatcagcttatgggctgaggccacgagttatacacatgtgtgatttcagtcacacacactctacttcaggaccacacctgtgttctgaggagctcaggcacctgctgatctcagtaattctctaataaatcacacacctcttattaataaaggtccagatggccccatcagctgcagagcagtggagtaaagctcatgggtgggtccatcaggcagaagtcagacaatggaagggatggctggtcacttccattttcactgatgttcgcaatgaattttaatggaataaaacaatattaactacaaagagacagaaaagaagactggctcgtcaagatatttaaggacaaggaactttatttggggggaaagtgaaagacacttctaaatggaaatccctaaagcacatacagcagctgacagagtggccactgtgcacatgagggctgaggagatggatggtagagtccattcctgcaacatgtctctgggtgtgtgatggttagactcctcatgcatatgaatataagagctggactcatggagaaaaaaagggccatatcccataggaaaggaagaaaaaaaaacagatgggcacccctggagagagctcattagatttggtgtgtttaagatgaaaatttcttccaaaaattgtaatgttctaagctaaatatgaatctcttcaataaactgagaataggagaatggagctaggacttgagagaggaaacaaatcttgagagagcagaaagcaaatccacaaaaactgtcacatgacagaggtcagaatggagctgatgtagctacttcactattctgcagacttattgaccatgtggagaaggggcttgaacaaatggagacgttctccaaccttctgaatcagcctccttcttatgcatgagtagaaatcatagttctgggggtgaccttcccaattttcctgtccatacctcttcccccaggggtagagtgtcttcccaaccacaatggtttctcaccagtgttctcagcttctcctccattgtacttaccctgcagattaagaatttcttctagatggagttctttgggaattttctgttttctttagtttctgttgactccaccacacccccataggatacaggttttattggatttcccctggaaatagtgggggtggatccaggcgttcaacagtcctcgctgttcttcccttcctgtcagcaccacaggacagcagataagggagttgactgtggatttttcaaattcctgggaaaagcctgcaaggactagtagattcacactctaataccattagcacatgtatccaaaaagaaacctcactaaatatttccaggttagcctgttcctctctcagtgccatccagtggcacctgccctgggttcacgaacatgtgggccccagtcctctctgctggcatctctctcctcacatttcagtcttctcgttagctctgtgaaagcagctcagatatgttaaaaggttttcttcttcatttattcagtttttcaggtttactgttaaggaggtcagaataagatcatagtttcctcatttttcacatttgcacgctgagtagccactttctatataaaagccagaaactaagggaacaaatcaaatatccatatccactacaggtgaacgttaaaaaatttgacatatgattatggactaaagtacaatgcagaattagaatcaaggcatcctcattctcataaaagcatgtctacattctcaaataactctgctgagtgaaagtagctgaagaattaagagtgcacttcataaacttctaattgtataaactgcagaaggtacaactattctaaagtaacagagcagatttgaaatttgggagaaatgggtgttgaaagtaattgggtggtgagatgaaattacagagaagtgacagaaagatttaggggttaacttaattgtacacaacctgattaaagtttgcacacatacgttaccattttccaaatggtgcagtgtagatttgaattaattattaattgtacttaaagcagtaacaaagaaacaaatgaatatgttggttgaggaggagcaaaaaatagatgggtatgaacactcaaaacatctcagactcttgaaagtacacatgcttgaacactggttttctctgtatactttaggtaaagagcagaatacattaaaagaaaacagagatgtcctggcgggggtggaatcctgcaaacctcactaggcgtgtcccacactgccctggagttgtctcaggggagcagtctcctctagtggtcagagacacaggcatggataatggggctaatactgtccagctgtgtgaccttgaacacattgtataaacactgttccatatgtaatttatcttccttaaaatgtaacattgacacttgcattaaatgtattctacaaatatgtcaaaaagaagatgacgactgctaaatgattatcaaggcacaatcatataatataatgatattttcctgagtgataagatgactaccaatctcccccagggcactttgtttgctctgagccctgcgcctcctcaggattcccatcccagagcttgctatacagtaggagacatgcaaataggtttctccctctgctgatgaaaaccagcccagtcctgaccccacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgtatgtgaggcaccaggtaagaggacatcagtgtgaacacagacacagtttcctgcaatgacaagggaggaggctgggctaaaaggggcactcaggacccactgaaaacgggcagctctagggcaggtacagatggttatcatgggctgctttccttcagggtctgtggcctcctctgcatctaccagttcccctcggagcctctggacatttatgtttctgtggccacccctgacatctctggattagaaaagtttattataggaagaggaaacattctcatttgtcccaaagcagatgtaagtaatggaagcaaaaaatgcacaggaggccaggcggggctgtagatactgtcaccccagaatgtcaatctcaccactagtactggagagggaagggagtttgatggaccttccctaacaaccctgtggtccaagataagtccaggaagaccattggtgcctcccagagcacagttgtccatcagggatgtccaatgcgtcccagcagcagccatgcctcagtgtctccactgtgcacagccactgtctgggaggagctcccaggatgggtgtctttggcacacaccaggtggcgggtgttagagtgcagtgcagcagctggctgcctgttctattgggctccctgatgctggagagatgggaggtgcattcgcagggccagcaccctgtttgtgaatttttatataaaaaccctgattttacttcatttttgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctggcacaatcagagcctgcagagacccccaggtgcagcttcagtgaagtcagacatttctccatgtgggcgacctccagtgcctgtgactgctgctcaggcctaattgttggttaagtattacgacaccctttaggtgatcacatctcaagcctattctgaaaatcaccatgaacagagatagttcaatggccattctcctgacataagtttctctttattacttggttccaagtatggagaaaaatgtgaccctatatttgtctgaatccaacatcagcatccacggcattacgctaggagactcactaattgagcacaagtgagctcgttattctcatagaaatgtaagtatttggaaatttcagcgtgttctccagaacctgtggctgccaacaactgtatttctcggtgcactcttggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaaagggtgcttggtacagcagggggctcaggattattgtggggattcagaaagagcaggttcaaggctcaacctcagggcatgtgcagctggtgtgaaaaggggctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctatgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtgggagtttcaaaccctatcaacccccctataaactgtcattaagaaagtttatcaaactccaccagtcatgtgatattagttcgttttcacagtggtataaagaactacctgagacgaggagtttacaaagaaaagaggtttagttgactcacagttctgcatggctggggaggccacaggaaacttataatcatggtggaaggtgaaggcgaagcacggcacatcacacagggcagcaggagagagagggggaagtgacacatagttttaaactatcagctcttgtgagaactcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcgcaggaaaatctaaaatggcttgaaagaagaggaaaggagactggctcagggtttttataatggtttagtggtggtggcacagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagcgacaacttattctaggtagcaagaataaaaataatgaaaaagaaataagggttcagtatgggtggacaagacccagatctacagaaatgagatgactttagaaatataaggaaataataatgagaaaaagaaggaggggatggggaattagggtcctggcctaatgtcttgggtagaagcttctcacaatcaaggactatcagcttattctgcaggtcttgggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgagctccggactcacgtaatcttcctgtattagcctcctgaatatctagaattagaggggaacgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattcttcagttgtaaaacatgaagccaataattaactgcctgactgttttgtgcagtgagttagttaaaagtttctgataagattccttccaatatgattcaagagcagtattttctgctgatgttcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagtttacattttattaaaattgataatttttatgtagcgatgccattttttaaacattcccagaaggttgtgagtgggattgactctgtcttctgtgaacaatgacagtgccctccatggttagataatattttaaactagattgagctagagtggtttctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacctagcactttgggaggccgaggtgggtggacccctcgaggttgggagtttgagaccagcctggtcagtatggtgaaacctcatctctactaaaaatacaaaaattcgccgggcatggtggtgtacactcgtaatcccagctacttgagaggctgaggtgagaggattgcttgaaccctggaggcgggggttgcagtgagccgagattgtgccactgcacttcagcctgggcgacacagcgagactccgtctcaaacaaaacgacacaaaaaattccaaagttgtgcaccctctaaaagcatatgtacttaattctcatttttaatttattaaacatctctaataagttcaatgtttcctgccttctgagttgatttcctaacacatagaagaatatatcctaaatgaaagtttgtgttcttaatacaaattactagttaataacctttacttttattattgaggtattatacatcaatgttaatcaatcctctcaatgggactcttacctaaagaatatataaaatattttcctgatcatgacatataatagatgtgaacacattcttagcattcagccatgtctcttgtctattaatattataaaccacatgctaactttgattttattggtaattgttctaatttcttttttttcccacttctctggttgttttttttttaactttaagttttagggtacatgtgcacaatgtgcaggttagttacatatgtatacatgtgccatgttggtgtgctgcacccattaactcgtcatttaacattaggtatatctcctaaagctatccctcccccctccccccaccccacaacaggccccagtgtgtgatgttccccttcctgtgtccatgtgttctcattgttcaattcccacctaggagtgagaacatgtgttgtttggttttttgtccttgcgatagtttgctgagaatgatggtttccagcttcatccatgtccctacaaaggacatgaactcatcattttttatggctgcataggattccatgatgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagggataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcggcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatttccaagccagcctgttccgatcttaaatgccatccagtggcatctgccccaggtacactaatacatgggtcctgcttctctctgcagcctcctctctcctcagatttcaggttttgtttattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaattaagagtaaattttacatgatacatttgtagaaattttagaagatgccactattataaattaacatggagaagatttaaatgtttctgagaatatgctattgggagtaatggggatgtgagttaaatttcagaggaataagagaaagatttagggattaattttttcaaaccttgattgaagtgctgagtaaatggttgcaaacataggtctacatttttcaaatcattcaccataaatttgaattatttattaattacactcgaataaagcaataaagaaactgatgagataatatttgactgaattgcatcaataaatagatcgatattaacacaaggaatataactgatttccaaaaacatacacatgaaccatggttcactctgcgtatttagataaattacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagacacagtgaggggaggtcattgtgcgcccagacacaaacctccctgcaggaacgctggggggaaatcagctgcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgattcttctccaatcagacccaggacagggacctccgtgagattccctgactggaacagtctttatggatcctggtcacagacaatagagaggctgaaccagggtcagcgtcatgtagaacgtcacagatttcacgtctgatccttctcctgacacgaaagtatgcaaatcagtatcagcaccgatctggtgcttcttttgttcctaatccatttactttcttttttcgtcgtttttctcctttttccatttgtttttcctgctttttgcaaaaggaagatgttttccctgtgagatgcaggggatgacaattttgggagatggctggaacatccaatatcctcagggccgaccatcagtaagtgcaggctagaagtctcagaaagagctgaagctgcttaatcaccgtggagttttaccttctccagttctgctctgatggaatcagggccaagcaggttatcaatgataatctacctaacatagagtcaactgattccagtttcaataacgtctgttaaaaattcacaccaccacctggattactgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccattttgacatgaaaactttttcagatatatggcatattatccaattctgtaagttgtagttattttgttgctttgcagaatctttttcataatctattcccacttgttcaattctgcttttttttgtaggtgatttgaatgtaaaatcctgaaaaagattgctaattttttgagtgttgagagttttacaattagaggtattacagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagcttgtcatcaatatgtgggtttatatctaagctctatataggtatttaagccaaaactttctatgtttttaataaatgttgaggcctggaagtgaaatgcctaaagctttcttcttgccttgttacagatattgtaccaaaatattctaaccttttactattgagtgtaataatagctgtggcctttcttaacggcttttattatgttcaagttgttttcttgtcttcctactttgttcatagttttaataatgaaactgatttttttcaaagtctttttctgtgtctgatgaaatgttactgagatattttttctttagttttttaatgtgtaccaaactgattgatttgagaatgttgaatcaagtatgcatctcaggaagaaatttgagttggtcatggtgtatgtcttctaaaacactttggagcttagtttactattgttggggattaattcatgtctactaatgatattggtctgtagtttcctttattgtggtgcctttgtctattactggtaatactatcatggtagtctcatagaaagagtttagaaggtgtatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttacctttcctatttatttttaagtttgtttttagacatatgcaatacattttgaggtgaaacctggtggaattttttccaataaattagtaaaaataaatcatttaattgactattttattcaggttgatttgtttaatatttgctaaaggccagttctttaagctatgacacataataaatcccaaatggcagtacctcattgtttacttagcttttgtacttatatttttcagaggaagaaccactactgtaaattgtaaatagccaatacataattgtattgtatgcaaatctgtgactgtttacagtgtcatctctgagaaacataaagtttatttactatatatatataaagagtttggaaggtggactccaccaatttttgaaagagttacagaagggctgctattacttctttaaatgttaaggttcattttatgatgtaacagataacctatcatggagaatgttcaatgtgttcttgagaaggatgtgtattacgtgactcttggttggaaggttctgtaaatatcattcagataaatttgttcaatagtgttgttcaagttcagaggcacattgagaattttctttctggatttgctaaacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaagtcctcctggagtctgacgtctgctctgggcactgccttcttctcaggcgtcccacactggagcttgctatagaggaggaggcatgaaaacagggccctccctctcctggtgaaatcaagcccagacctgaccctgcagctctgggagaacagccacagccctgggattcccaggggtttccatttggtaatcaggactgaacacagagaactcactatggggtgtgaattaagctgaatttttcttgttggtattttaaaaggtgactcctagggaactagagtgagtgagagtgagtggatatgagtgagagaaacagtggatatgtttgccagtttctgaccaggatgtgtgtgtattttcaggtgttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacataaggtcccaagtgaggaaatatcggtgtgagtccagacacaacatttcctgcaaaaagaagaaaggagtctgggccgaaggggacactcagcactcacaaaacaggtgcagccccaaggcaggtgcagatggagggagggtaagggctgctttccttcagggtctgtggtttcctctgcttctaatatttcccctctgaacctctgtatatttatgttttgtgcccaccatgaggtccctggattagaaaactaatttaaaagaggaaatattctcatatgtcccaaaaacagatgtaagttttggaggcataaaaatgcataggagccgcgtgagtctgtagacactgccaccccacaatgccagacccaaaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcagtatctccactgtgcacagccatcgtctgggaggagctcccaggatgggtgtctttggcacacacaggtgatgggtgttagagtgcagtgcagcagctggctgcctggtctattgggctcctggatattggagggattggaggtgcattctcaaggccagcacgctgtttgttaatttttgtataaaaaccatgtgatttaattcattttctcagatgacatagataattaataacacaatctgcaaacaattgtaattttcaactttaccccaagttcattgtttcttaattctgtgcaggatccagacatggtattgcccttctcatgagaaattgttcgacctaaactgaaaccagttgtttctcatatactttggttctccccacatgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtgggctcagaattaggacagtcttcaggttatcacagatcaatcatattctaaaaatcatcattatcacacaccgtggtaataattcaatgttcatttttctaaacagcagtttctcttttttatttggttgcaagtttgaggaaaggagcatgtgataatactttttaatctaacctcaaaatctactgaattgttctaggagactcacaaattggacaagagtgagctccttgtgctcataaaaaatgcatgtatttgggaatttcaccgtgttgtccagaaactgttaacatcaacaactgtgttttccagtgcacttctggcttgagacatcctcacagaccctctccctcacctgcactgtctctggattccccatcataaccagtgtgtcctgctagaattgtatctgcttgcccctagaagatggacaggagtggatcaggttcatgggttgtaaagggagcaaaaattacatcccacttctcaagagtccatatccagatccaagaaacagttcttacagctgagctctgtgcccagtgaacacacaactacacattttgaagcaaaagacgcaatgaagggccttcattgtgagcctagacacaaacctccctgcaggggtgaataggagcagcagggggcattcggggcagtatgggggcttagcatgattgttgggggtcaagatgagcaggatcaaggctcatcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatgtatacccaaatggaggtgcatccagttgtcctctccatcttatgtggaccttgtccatcaagggctaagttcctgtatttacttgattacctcatacattatggtcaaaacaggtagggtctcattttggcatggtctctcctcctcccttctctctgtcgcacaaaaacacatgaactgacacacacagagcttcccaacttcaattatctgatgtattgaagcaaattgattagtgtgcagcttttctgctttgcctgctattcatgttatgtaaaaataagaaccgtgtgtttctcagcttgttacttctctaagctaagtagcatctttgtttattatacccagagaccaaaagcgattcagctgttattcagcagcttaactggtaaacaaattgtggaaaattcatttactggaataatacccactgttacaatgaagtactgctggatacactcagtaccatgcttaaaataacaagtacctgaataagtaaaataagtcaaacaaataaaagtgcatacatatgattccacttctataatttctataaagtaaaaatgaacttaaagttacataaaaagatctgtagttgactggggacatggtacaagaagagaaggtatagaaaggagaaacgacaggagagcaaaaggaaatttctaggataattttttctctgttagtaaaagtgaggattatgtcactatttgtaaaattgtccactttatgtaaaggttcttatttgctaatttcacctcattaaaatattgcaaattttaaaatatctaatttggtagaaaaggtagtagagagagatgaataaaatacataaaattcagagagtcctgaatacacacatgaatggaccctgggtctcactgtacttttagggagacactagaatacaaaaacataatgacaggatttcagtacatgaaaggagcttctcagaccccaggaggcctgtccaactgcgtctgggagttaactcagggagcaggcatgtcctttggaaggagcaatgacaccaagctcccagcatccattgtagccgacaccatgccaatgccaagagatctcgactaaaattttctgtggatgttgagtgtgattatgccacacactcacaccaagtgagtatggaaaggatagttacctgcatccttaaggtgtctgctgagagcagggcaggtctctcattaaggtccaaagtggcttgatagagcagggaaggagactggctctgggttgttatcatggcttggtggggagcggggcagagcatcctacttgcaggaagggttttgtggggtttcaaggtcaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcacagtttaacttcctctatttgagtagctttacaattgtgtagagttcttaattaattaattttttttttggagacggagtctcactctgttgtgcaggttggactgcagtggtgtgatcataacatagctcacggtgatttcaaattcctggctcatagaatcctcccacctcaacctcctgactagcaagtagctaggtttccagggcccttcatctacacttggccggttcttttcattctttttttttttttttaggtggagtttccctcttcttgcccagactggagtgcaatggtgccatctcagctcactgcaatctccccctcccaggttcaggtgattctcctacctcagcctccagagtagctgggatcacaggcatgtgacaccatgccccgctaatcttgtatttttatcagagatgacatttctccatattggtcaggctggtctcaaactccctacctcaggtgatctttccacctcagcctcccaaagtgctgggattacaggcgtgaggcaccgcaactggcctcttcatttttattcatatgttccttcagcagccactatgtcttcccactgatttcttcagtttctgccttttccttttgaataaggcattattcctaagggaagtcgggaggtgggcctggacagggacttggtgcattcctctctcccgtcccagttcttattggtttctccagtggctgtagaacagcagttttgatggctttacctctgcagataatttctcttgcaatgtagtgctgatggggaggtgtgtctggatgcacttcacctatagttgctgttttgctttcccagacagcaccatcccaaggggtagagggtggagcattttgtgatgtatccccagtactgaagaaaaaggcttcaatagcaggaggaattcctcaactgtatacactctgagaatttaaacaataacttctctatcatactcaaattgaaaccatccaatgaatatgtctactttaatcgtgtgctaacttaaatggcatttggcagcctctgtgccagaaaagattatcatctgctcctgtttatttccctgcaagtccttatctctcttcagatttcagatatattgtttgtcctataacatcaaaaatttgatgtatatgtgctaatttgcagatcagtaagtttagtagctgttgtaagaataataacatatttttatggggtgcttacatctccaagctgagaagcacctctatgtgtaatactaagaaactagaaatgatacaaatatcaagaagatacatagataaaaagtaatggcatgctaatttactgtaataacatccatcatgagaatcaatacattgttgatgctcaacatgtttgcatcataagtagttatgtgcgagaagccacacaaatagaacacatactatataattcctgtataattcttgaaactcaaaactaaagcattaaatatgaaggactgactcagaatatggtggggaagaaaatatttgggaaggaggaattgtagaggaacacaaggaaacttttaagtgtaatttgtttgttcattatttggatggcttttggggatgcaaaggtgagcacgagtggaataacattttgttttgtttgtttgtttgtttttctgaagagatgtggtccttctctgtgacccaggctggagtgtagtggtgggatcatagttcaatgtagcctctaacttctggtctccaacaatactcctgcatctgccatctaagtagctggaactaccgttgtgtgccaggaggtttggcttggcttgagtacttattaaaccacacactttttgcaatatttaatgtatagtaataatgtctcaataagactattacaaatcaatgaatgaataatttgttcagtacagattcatggaaaaatagacactaacatgatgagtgtctgacatttatgaaaatacagctgcatgaaatgtgcttctctttacattcattaggtaaacacaatagtgcatacacatcacaccgtgctttcattacaggaagaaagttctgaaaatgtcactggggtgaaccacacggtgctgggcttggttcagggagcagtcaggcccagtgttgtgaccttcaaccacagaatccttaaaaaaaaaaaaaaaaaaaaaaagaggctgcctcaaagtccgcatcagttcccggactcgctatgtttctggatcgtatcagtgcatccggatctccctggtggctttagtgattccttgcttgccatgctgaggtctcgctgtagattatgttgggttttctaagaccgttttgctattgtaagatccactccctgggacagagcgattccctctaaacctgatagaggttctgaactaaaaataacattaagtgaatcctggtgtgtctgaactcaagtgattgttacattaagctgctgttccaatctgtttcctcacctgggaaaagaggagccaggacatagtgagttgaggccccaggaagataactgaattctcagagggcacagccagcatcctcctcccagggagagtctaaaagactggggcctccctcatcccttttcacctgtccatacagaggcaccacccacatgcaaatctcacttaggcacccacagaaaaccaccacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgatcccagggctcactgtgtgtctctctgttcacaggggtcctgtcccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagacacaatgaggggaggtgagtgtgagcccagacacaaacctccctgcagggaggcggagggggcgggcgcaggtgctgctcaggaccagcagggggcgcgcggggcccacagagcatgaggccgggtcaggagcaggtgcagggagggcggggcttcctcatcagctcagtgctctccctcctcgccagcacctcagctgtccccaggcctcctctttctttattatctgtggttctgcttcctcacatccttgtggtaggaaaggaaggaggaaggcaaattttcctcttacagtcaaagtgtcactaattactaggaactttcctacaagttcctgaatgtcccatttttccttcttaattaaaaaaaatatatattctaatacttctcaccatctcttgatttgtgtcatcagttgaattgtgctgtctttgaaattcaaatgctgaaaccttaaatccaattgatctatattggaattttaaggatggaattaaggttaaatgtgatcataagtctgagattctaatgcaatagatctgttgtctttataagaagtggaagagtcaccagagacctctcacttttcccgtgcacgcagagaagaggccatgtggagacatagtggactagaaggtgcaagccaagaagaagccgcaccaagaaccaaccctgccagcacctggaccttggacattcagacttcagaatggtgagaaaatcaatgtttgttgtttaagccacccactcctgttgtcttcttatgaagacccagacagactaataccacataactctgttagctcctggagggagaagcagctccctgaggctgggcacatctctcagatatccatatgaagtaggcagaaatagtagttctcatataaaaatgtgtcatggccctgttggccatttttttttgacggagtctcgctctgtggccaggctggagtgcagtggtgcaatctcagctgactacaaaccccgtctcctgggttcaggcaattctccttcctcaacctcctgagcagctgggactacaggtgtccaccaccatgccagcctattttttttttgtatttttagcagagacagggtttcactgtgttagggtggtctcaaatctcctcactgcatgatctgcctgcctcggtttcccaaagtgttgggattacaagtgtgagccaccgcacctggcccctgttggccattcttggggcaatgtctctgaaaccagccctggtgcctgtaccacaaaattttcttttatctttcatgtggatataacaaatggacaatgaggaccagctgcatggagactgaccactgaacatcttctgctgtctcctaagtaagtcacaggaaaacacaccaacatcaccaacataactgttttccttcaacttcctcgaacgaactatagaaatgatcccttaaagtatagtctattccttcaactttctcaatttgcactgaatcccttcctaaattaggagctacatagggtctgagttttgttccctttctcccagtcttccccaagtatcaaggacagaatagatttaaattaaatttggccgtccatgcccccaacaccacatcggtttctaacatccttgtcatgtacccatccttctgtgggcaccccacatcaggttggccaggaatggccagaaggtgtcatcaccttatgggctgaggctacaagttatacacacgtgtgatttcagtcacacacactctactgcaggacacacctgtgttctgaggaactcaggcgcctgctgatctcaggtcttctctaataaattacacacctcttatgaatgaaggtccagatggccccatcagctgcagagcagtggattaaagctcatgggtgggtcagtcaggcagaagtcagacaatgggataatagaagtcagacaatagtcactgaggttcccaatgtattttaatggaataaaacaatattagcaacaaaggggcagtaaagaagactggctcttgaaggtatttaaggaccaggaactttatttggggggaaagtgagagacacttttacatggaaagccctaaagcacatacagcagctgacagagtggccactgtgcacatgagggctgaggagacggatgataggttacgttgctccaagatgtccctgggtgtgtgatggttggactcctcatgcatatgaaaataagagctggactcagggagaaacaagggccataccccatagaaaaggaagaaaaaaagcagatgggcacccctggagagagctcattagatttggtaggtttgagatgaaaattacttccaaaggttttaatgttctaagctaaatatgaatctcttcaataaagtgagaattaaaagaagaatggagctaggagttgagagaggaaacaaattatgagagagcagaaagcaaatccacccaaactgtcacatgacagaggccagaatggagctgatgcagctacttcactattctgcagacctagttgaccatgtggagaaggggttcgaacaaacggggatgttctccaaccttccaaaacaacctccttcttatgcatatgcagtaatcatgattctcagggtggccttcccaagtttcctgttcttacctcttcccccaggggtagagtgtcttttccaacccacagtggtttctctgccatgtcctcagcttctcctccattgtacttaacctgaagattaaggatttcatctggatggagtttcctgggaatcctctgttttctttggtttctgatgaccacatcacaggccataggacacaggttttagtggatttcccctggagacagtggaggtgaatccaggcgttccacagtccttaccgttcttctcttcctgtcagcaccgcaggacagcagataagggagctgactgtggatttttcagatccccgggaaaaagcctgcaaggactaatagtttcacatctaacaccattagcacatgcatccaaaattaaaaaaaaaatcctcactaaatatttccaggttagcctgttcctctctcaataccataccgtggcacctgccctgggttcggtaacatgtgggccccagtcctctctgtaggcgtctgcctcctcagatttcagtcctcttttttgctccgtgaaagcaactcagatatgttaaaaggttttcttcttcatttattcataatttttcaggtttgttgttaatgaggaaagagtaagatcatggtttcctcatttttcacattcccatactgagtaactgctctctctctatgaaagccagaaattaagagaacaactcaagtatccatatccattacaagtgaatgttagacaatttgatgtatgattatgaactaaagtacaacacaggattagaatccaggcatcctcattctcataaaatcatggctgcattcacaaataactgtgctgagtgaaagtagctaacaaattaacagtgcacttcataaacttctatttgtataaactgcagaaggtacagctattctaaagcaacagagaagattacatattggtgggaactgggttttgaaagtaatggggtggtgagatgaaattacagagaagtgacacaaagatttaggtgtgaattgtacacaaattaattgaagctctgattaaagggttgcacacatgttaccattttccaaattatgcagtatatatttgaattaattattaattgtatttaaataaagcagtaacaaagaaacaaatgaatacatttattgaggtggagccaaaactaaatgggaatgaacactcgaaacatctctgactcttgaaaatacacaagcgtgaacactggttctctctatgtatttcaggtcaatagcagaatacactaaaagaaaacagagatgtcctggcaggggtggaatcctgcagacctcactaggcatgtctcacactgccctggagttgtctcaggggagcagtctcctctagtggtcagaggcacaggccgagataatggggctaactctgtccagctgtgtgaccttgaatgcattgtataaacactctgttctctgtgtgatttatcttccttaaaatgtgacattgacacttgcattaaatgtattctacaaatatgtcaaaaagatgatgactgctaaatgattatcaaggcacaatcatataatataatgatattttcctgagtgataagatgactaccaatctcccccagggcactttgtctgctctgagccctgcacctcctcaggattcccatcccagagcttgctatacagtaggagacatgcaaataggtttctccctctgctgatgaaaaccagcccagtcctgaccgcacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgtatgtgaggcaccaggtaagaagacatcagtgtgaacacagacacagtttcctgcaatgataagggaggaggctgggctaaaaggggcactcaggacccactgaaaacgggcagctctagggcaggtacagatggttatcatgggctgctttccttcggggtctgtggcttcctctgcatctaccagttcccctcggagcctctggacatttatgtttctgtggccacccctgacatctctggattagaaaagtttattataggaagaggaaacattttcatttgtcccaaagcagatgtaagtaatggaagcaaaaaatgcacaggaggccaggtggggctgtagatactgtcaccccagaatgtcaatctcaccactagtactggagaggcatgggagtttgatggagcttccctaacaactctgtcttccaagataagtccagcaagaccattggtgcctcccagagcacagttgtccatcagggatgtccaatgcttcccagcagcagccatgcctcagtgtctccactgtgcacagccactgtctgggaggagctcccaggatgggtgtctttggcacacaccaggtggcgggtgttaagagtgcagtgcagcagctggctgcctggtctattgggcctgatgctggagagatgggaggtgcattcttggggccagcatgctgtttgtgaatttttatataaaaactctgattttacttcattttcgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctgcacaactcagagcctgcagagacccccaggtgcagcttcagtgagtcagacatttctccatgtgggcgacctccagtgcctgtgactgctgctcaggcctaattgttggttaagcattaggacactctttaggtgatcacatctcaagcctattctgaaaatcaccatgatcagagatagttcaatggccattctcctaacataagtttctctttattacttggttccaagtatggagaaaaatgtgaccctatatttgtctgaatccaacatcagcatcaactgcattatgctaggagactcactaattgagcacaagtgagctcgttattctcatagaaatgtaagtatttggaaatttcagtgtgttctccagaacctgtggctgccaacaactgtatttctcggtgcactcttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaactatgtgaggaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaatgggtgcttggtacagcggggggctcaggattattgtggcgattcagaaagagcaggtccaaggctcaacctcagggcatgtgcagctggtgtgaaaaggagctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctgtgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtggttgtttcaaaccctatcaacccccctacaaactgtcattaagaaagtttatcaaactccaccagtcatgtgatattagttcgttttcacagtggtataaagaactacctgagacgaggagtttacaaagaaaagaggtttagttgactcacagtgctgcatggctagggaggccacaggaaacttataatcatggtggaaggtgaaggcgaagcacggcacatcacacagcgcagcaggagagagagggggaagtgacacatacttttaaactatcagctcttgtgagaagtcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcacaggaaaatctaaaatggcttgaaagaagaggaaaggagactggctcagggtttttataatggtttagtggtggcggcagagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagtgacaacttattctaggtagcaagaataaaaataatgaaaaagaaataagggttcagtatcgatggacaagacccagatctacagaaatgagatgactttagaaatataaggaaataataatgagagaaagaaggaggggatggggaattagggtcctggccgaatgtcttgggtagaagcttctcacaatcaaggactatcagcttattctgcaggtcttaggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgacctccagactcacgtaatcttcctgtatcagcctcctgagtatctagaattagaggggaatgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattctttacttgtaaaacatgaagccaataattaactgcctgactgttttgtgcagtgagttagttaaaagtttctgataagattccttccaatatgattcaagagcagtattttctgccgatattcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagttcacattttattaaaattgataatttttatgtagggatgccattttttaaacattcccagaaggttgtgagtgggattgactctgtcttctgtgaacaatgacagtgccctccatggttagataatattttaaactagattgagctagaatggttgctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacccagcactttgggaggccgaggtgggtggacccctcgaggttgggagtttgagaccagcctggtcagtatggtgaaacctcatttctactaaaaatacaaaaattcgccgggcatggtggtgtacactcgtaatcccagctacttgagaggctgaagtgagaggattgcttgaaccctggaggcgggggtcgcagtgagccgagattgtgccactgcacttcagcctgggcgacacagcgagactccgtctcaaacaaaacgacacaaaaaattccaaagttgtgcaccctctaaaagcatacgtacttaattctcatttttaatttattaaacatctctaataagttcaatgtttcctgccttctgagttgatttcctaacacatagaagaatatatcctaaatgaaagtttgtgttcttaatagaaattactagttaataacctttacttttattattgaggtattatacatcaatgttaatcctctcaatgggactcttacctaaagaatatataaaatattttcctgatcatgacataaagtagatgtgaacacattcttagcattcagccatgtctcttgtctattaatattataaaccacatgctaactttgattttattggtaattgttctaatttctttttttttcccacttctctggttgtttttttttttaactttaagttttagggtacatgtgcacaatgtgcaggttagttagatatgtatacatgtgccatgttggtgtgctgcacccattaactcgtcatttaatattaggtatatctcctaatgctatccctcccccctcccctcaccccacaacaggccccggtgtgtgatgttccccttcctgtgtccatgtgttctcattgttcaattcccacctaggactgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagtgataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcagcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatgtccaagtcagcctgttccgatcttaaatgccatccagtggcatctgccccaggtacactaatacatgggtcctgcttctctctgcagccgcctctctcctcagatttcaggttttgtgtattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaatgaagagtaaattttatatgatacatttgtagaaattttagaagatgccactattataaattaacatggagaagatttaaatgtttctgagaatatgctattgggagtaatggggatgtgagttaaatttcagaggaataagagaaagatttagggattaatttattcaaaccttgattgaagtgctgagtaaatggttgcaaacataggtctacatttttcaaatcattcaccataaatttgaattatttattaattacactcgaataaagcaataaagaaactgatgagataatatttgactgaattgcagcaataaatagatcgatattaacacaaggaatataactgacttccaaaaacatacacatgaaccgtggttcactctgcgtatttaggtaaataacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagacacagtgaggggaagtcattgtgcgcccagacacaaacctccctgcaggaacgctggcgggaaatcagcggcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgagtcttctccaatcagacccaggacagggacctccgtgagattccctgactggaacagtctttatggatcctggtcacagacaatagagaggctgaaccagggtcagcgtcatgtagaacctcacagatttcacgtctgatccttctcctgacacgaaagtatgcaaatcagtatcagcaccgatctggtgcttcttttgttcctaatccatttactttattttttcgtcgtttttctcctttttccatttgtttttcctgctttttgcaaaaggaagatgttttccctgtgagatgcaggggatgacaattttgggagatggctggaacatccaatatcctcagggccggccatcagtaagtgcaggctggaagtctcagaaagagctgaagctgcttaatcaccgtggagttttaccttctccagttctgctctgatggaatcagggccaagcaggttatcaatgataatctacctaacatagagtcaaccgattccagtttcaataacgtctgttaaaaattcacaccaccacctggattagtgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccatttggacattaaaactttttgagatatatggcatattatccaattctgtaagttgtagttacttggttgctttgcagaatctttttcataatctattcccacttgttcaattctgctttttttttgtaggtgatttgaatgtaaaatccagaaaaagattgctaattttttgagggttgagagttttacaattacaggtattaaagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagctcgtcatcaatatgtgggtttatatctaagctctgtataggtatttatgccaaaactttctatgtttttaacaaatgttaaggcctggaagtgaaatgcctaaagctttcttcttgccttgttacagatattggaccaaaatattctaaccttttactattgagtgtaataatagctgtggcctttcttaacggcttttattatgttcaagttgttttcttgtcttcctactttgttcatagtttttataatgaaactgatttttttcaaagtctttttctgtgtctgatgaaatgttactgaggtattttttctttagttttttaatgtggtgtaccaaattggttgatttgagaatgttgaatcaagtatgcatctcaggaagaaatttgagttggtcatggtgtatgtcttctaaaacactttggagcttagtttactattgttggggattaattcatgtctactaatgatattggtctgtagttttcttttattgtggtgcctttgtctattactggtaatactatcatggtagcctcatagaaagagtttagaagatatatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttaccttttccttttaatttttaagtttgtttttagacatatgcaatacattttgaggtgaaacctggtggaattttttctaataaattagaaaaaaataaatcatttaattgactattttattcaggttgatttgtttaatatttgctaaaggccagttctttaagctatgacacataataaatcccaaatggcagtacctcattgtttacttagcttttgtacttatatttctcagaggaagaaccactactgtaaattgtaaatagccaatacataattgtattgtatgcaaatctgtgactgtttacagtgtcatctctgagaaacataaagtttatttactatatatatataaagagtttggaaggtggactcctcaccaatttttgaaagagttacagaagggctggcattacttctttaaatgttaaggttcattttatgatgtgacatataacccatcatggagaatgttcaatgtgttcttgagaaggatgtgtattacgtgactcttggttggaaggttctgtaaatatcattcagataaatttgttcaatagtgttgttcaagttcagaggcacattaggaattttctttccggatttgctatacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaactcctcctggagtctgacgtctgctttgggcactgccttcttctcaggcatcccacactggagcttgctatagaggaggagggagggcccctctcctggtgaaaacaagcccagacctgaccctgcagctctgggagaagagccacagccctgggattcccaggggtttccatttggtaatcaggactgaacacagagaactcactatggggtgtgaattaagctgaatttttcttgttggtattttaaaaggtaactcatagggaactagagtgagtgagagtgagtggatatgagtgagagaaacagtggatatgtttgccagtttctgaccaggatttgtttgtattttcaggtgttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgtacataaggttccaagtgaggaaacatcggtgtgagtccagacacaaaatttcctgcaaaaagaagaaaggagtctgggccaaaggggacactcagcactcacaaaacaggtgcagccccaaggcaggtgcagatggagggagggtaagggctgctttccttcaggatctgtggtttcctctgcttctaatatttcccctctgagcctctgtacatttatattttgtgcccaccatgaggtcgctggattagaaaactaatttgaaagaggaaatattctcatatgtcctaaaaacagatgtaagtattggaggcataaaaatgcataggagccgggtgtgtctgtagacactgccacccccaatgccagacccacaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcaatctctccactgtgcacagccattgtctgggaggagctcccaggatgggtgtctttggcacacacagttgatgggtgttagagtgcagtgcagcagctggctgcctggtctattgggctcctggatattggagggatttgaggtgcattctcagggccagcacgctttgtcaatttttatatgaaaaccatgtgatttaattcattttctcagatgacatagataattaataacacaatctgcaaacaattataattttcaactttaccccaagttcattgtttctgaattctgtgcaggatccagacatggtactgcccttctcatgagaaactgttcgatctaaactgaaaccagttgtttctcgtatactttggttctccccatgtgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtggctcggaattaggacagtcttcaggttatcacaggtcaatcatattctaaaaatcatcgttatcacacaccatggtaacaattcaaggttcatttttctaacggcagtttctcttttttatttggttgcaagtttgaggaaaggaacatgtgataatactttttaacctaacctcgaaatctactgaattgttctaggagactcacaaattggacaaagtgagctctttattctcataaaaatgtgtggttttgggaatttcactgtgttgcccagaacctgttaacatcaacaactatgtttctcagcacacttctggcttgagacgtccttgcagaccctctccctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagcaaaagacgcaatgaagggccttcattgtgagcctagacacaaccctccctgcaggggtgaataggagcagcagggggcattcggggcagtatgggggcttaggatgattgttaggggtcaggatgagcaggatcaaggcttcgcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatatgtacccatatggaggtgcatccagttgtcttctccatcttatgtggaccttgtccatcaagcactaagtccctgtatttacttgagtacctcacacattatggtcaaaacaggtagggtctccttttggcatggtctctcctcctgccttctctcttctgtcacacaaaaacacgtgaactgacacacacacagagcttcccaactttaattatgtgatgtattgaagcaaattgattagtgtgcagcttttctgctttgcctgctattcatgttatgtaaaaataagaaccatgtttttctcagcttgtcacttctctaagctaagtagcatctttgtttattatacccagagaccaaaagcgatccaactgttattcagcagcttaactggtaaacaaattgtggaaaattcacttactggaatcatacccactgctacaatcaagtaatgctggatacacccaacaccatgcttaaaatagcaagtacttgaataagtaaaataagtcagacaaataaaagtgcatacatacgattccacttctataatttctataaagtaaaaatgaacttaaagttacataaaaagatctgtagttgactggggacatggtacaagaagagaaggtatagaaaggagaaactacaggagaacaaaaggaaatttctaggataattgatttttttctctgttagtaaaagtgaggattatgtcaatatttgtaaaattgtacactttatgtaaagattcttatttgctaatttcacctcattaaaatattgcaattttttaaatgtctagtttggtagaaaaggtagtagagagagatgaataaaatacataaaaatcagagagtcctgaatacacacatgaatggaccctgggtctcactgtactttgagggagacactagaatacaaaaacataatgacaggatttcagtacatgaaaggagcttctcagaccccaggaggcatgtccaactgcgtctgggagttaactcagggagcaggcatgtcctttggaaggagccgtgacaccaagctcccagcatccattgtagccgacaccatgccaatgccaagagatctcaactaaaattttctgtggatgttgagtctgattatgccacacactcacaccaagtgagtatggaaaggatagttacctgcatccttaaggtgtctgctgagagcagggcaggtctctcattaaggtccaaagtggcttgatagggcagggaaggagactggctcagggttgttatcatggtttggtggggagcggggcagagcatcctacttgcaggaagggttttgtggggtttcaaggccaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcgcagtttaacttcctctatttgagtagctttacaattgtgtaaaattcttaattaattaatttttttttgagacggagtctcactctcttgtgcaggttggactgcagtggtgtgatcataacatagctcacggtgattttaaattcctggctcatagaatcctcccacctcaacctcctgactagcaagtagctaggtttccagggcccttcatctacacttggccggttctttacattctttttttttttttttttaggtggagtttccctcttcttgcccagaccggagtgcaatggcgccatctcagctcactgcaatctccccctcccaggttcaggtgattctcctacctcagcctccagagtagctgggatcacaggcatgtgacaccatgccccgctaattttgtatttttagtagagatgacgtttctccatgttggtcaggctggtctcaaactccctacctcaggtgatccttccacctcagcctcccaaagtgctggaattacaggcgtgaggcaccacacctggcctcttcgtttttattcatatattccttcagcagccactatgtcttcccactgatttcttcagtttctgccttttccttttgaataaggctgttactcctgagggaagatgggaggtgggcctggacagggacttggtgcattcctctctcccctcccagttcttattggtttctccagtgtctgtagaacagtggttttgatggctttacctctgcagataatttctcttgcaatgtagtggtgatggggaggtgtgtctggatgcatttcagctgtagttgctgttttgctttcccagacagcaccatcccaaggggtagaggctggagcattttgtgatgtatccccagtactgaagaaaaaggcttcaatagcaggaggaattcctcaactgcatacactctgagaatttaaacaataacttctctatcacactcaaattgaaaccacccaatgaatatgtctactttaatcgtgtgctaacttaaatgacatttggcagcctctgtcccagaaaagattatcatctgctcctgtttatttccctgcaagtctttatgtctgttcagatttcagatatattgtttgtcctataacatcaaaaatttgatgtatatatgctaatttgcagatcagtaagtttagtatttgttataagaatagtaacatatttttatggggtgcttacatctccaagctgagaagcacctctgtgtaatactaagcaactagaaatggtacaaataccaagaagacacatagataaacagtaatggcatgctaatttatggtaataacatccatcattagaatcaatacattgttgatgctcaacatgtgtgcatcataagtagttatgtgcgagaagccacacaaataaaacacatactatgtaattcctgtataataaattcttgaaactcaaaactaaggtattaaatgtgaaggactgactcagaatatggtggaggaagaaaataattgggaaggaggaattgtagaggaacacaaggaaacttttaagtgtaatttgtttattcattatttggatggcttttggggatgcacaggtgagcacgagtggaataacattttgttttgtttgtttgtttgtttttttctgaagagatgtggtcctactctgcgacccaggctggagtgtagtggtgggatcatagttcaatgtagcctccaacttctggtctccaacaatactcctgcatctgccatctaagtagctggaactaccgttgtttgccagcaggcttggcttgagtacttattaaaccgcacactttttgcaatatttaatgtatagtaataatgtctcaataagactattacaaatcaatgaatgaataatttgttctgtacagatttatggaaaaatagacactaacatgatgaatgactgacatttatgaaaatacagctgcatgaaatgtgcttctctttacattcattaggtaaacacaatagtgcatacacatcacaccgtgctttcattacaggaagaaacatctgaaaatgtcactggggtgaaccatattgtgctgggcttggttcaggaagcagtcaggcccagtgttgtgaccttcaaccacagaatcctaaaaaataataaaagaggctcccccaaagtccccatcagttcctggactcgccatgtgtctgggccgtatcagtgcatccggagctccctggtggctttagggattccttgcttgccatgctgaggtctcgctgtagattatgttgggttttctgaggccgttttgctatttaagacccactccctggcacagagcgattccctctaaacctgatagaggttctgaactacaaataacgttaagtgaatcctggtgtgtctgaactcacatgattgttacattaagctgctgttgcaatctgtttcctcacctgggaaaagaggagccaggacatagtgagttgaggccccaggaagataactgaattctcagagggcacaaccagcatcctccttccagggagagcctaaaagactggggcctccctcatcccttttcacctctccatacagaggcaccacccacatgcaaatctcacttaggcacccaagggaaaccatcacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgagcccagggctcactgtgggtctctctgttcacaggggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaacacagtgaggggaggtgagtgtgagcccagacacaaacctccctgcagggaggcggaggagccggcgcaggtgctgctcaggacgagcagggggcgcgcggggcccacagagcaggaggccgggtcaggagcaggtgcagggagggcggggcttcctcatcagctcagtggtctccctcctccccagcacctcagctgtccccaggactcctctttctttattatctgtggttctacttcctcacatccttgctgcaggttttaacagtcactggcacccttttttcaacaaattcccacaaggcccattttaccttcttgacaagcaaaatattctaaggcttctcactatcccttgattggcgtcatctactgcatcgtgtctttctcttaaattcatgtgatgaaaccccaatcccagtggctctgtattggacagagggattttaagagggcaaataagttaactgtggccataaatgtgggaccctaatccagtaggactcttgtccttatgagaagtggaagacatcagaggcctctctctccacatgcacacagaggagagtccatgtggggatgcgctgcatgagaaggtggccctttgcaagcctggaagaggcctctcaaaaaacttaccctttctgcacccagatcttggacgtcaagactccagaacaataagaaaattaatatttgttatttgaaatagcctagtctgtggtatcttctcatggaaagccaagtagattcagagattcaattgtgttagctccgtctcctgcatggagtagcagcccaccgaggctggacacatctctcaaattattttcataaagaaaaatagatccaagatgaaaaccccaccacatttctgctgagccattcacttagcagcagtctctgagatcagccctgggggtatgttctaggtcgtgtatctcactttccactatgagaatccatgtagataatgagaaccagccagatggagtcctgatccctgcccaccttctgcttccccccaagtgacacacggtcacagaaaaccactccagcatcaccctgtgtcttgtactctctaaaatcccactaaagctgaccctaaactaggagctatttggggctggactcattctgttcttagtcttccataaggtccaggtgccgagtagagcctcagtaaagagtgagcttcaattcccctaacccacatcattcccttacatccttgtcatgcacctgtcctctgcaggcacccagggcaggttacacaggaattgcctgaagctggtctcaggtgccctgctgagaccactggttatgcacacgtatgatttcaggtcatgcaggctcttctgcaggacagacctgtgtcctgtagagcacagacacttggtgacccagggcctcctctaataactcatacatctcatgtcagtgtatatccaggtggcccctcagtgcagcacactagggtgattaccctcacaggtggctttttcaggcggtgaacagaaaatggggtgggcacgctggtcattcccatcatcggtgatatccaagtgaattttaaataaatgaaacaaaactaacaacaaaggggaaggatatgtacctgtatctgggaggtagactgggtcccagaactgtactgggagtgggtgtgaaaggcccttttgtgtgggaagccctccagcatgagtgaaagctgaaggaatgatcactgtaggtggaggctgatggagaagctggcagggtacatttcctgaagctgttcccgggtgcgtgatggttcaatggcccatgtacatgaagaggagggctggactcatgtaggatcaaggaaactaccccatggcaatggaagaaaagaaaatggagatggacacccctggaggcagcttattagctttggtggaggaacgatgggaatttattccaatgaccccagcattttcagctaaatatgagttgcattaacagacagaattatgaagggaagggagaaggagtttatagagggaaaaagcagaacagaaaaaaagaactatgcaagtctatcaaatggcagatgacagagtggagctgatgcagctacttcattcttcccggaacctaccagagaccttggcattcctgtaaggcaggtctagtggtgatgcacttgtccactttttgctttttggagaaacgtttgaaacatcctacattactgaagaaaagctttaattagtgtaatatttttacttgacagttttattggttttgttttattttcagcaacttgaatagaatcatgcacatcatgatatttgggtgaacaacaggccacatacacgataatgatctcattaaattataatactgtattttcactgcatttcttccatacttagatatgttcatatatatacatacctaccatggtgattcaactgcccacagtattcactacacttacatgatgtacagatttgttatctaggagcactatgctatcccacacagcctgggtgtagcagggtatttcacgtaggttcacgtaaacacactctatgatcctcgcatgatgacaaattgcctaaggacacattgctcagatgtatccctactgttaagctacacatcattgtatctcatctctctccatttttggtctctgataaaattctcgtgttgtttttgcattcttctctgagctcattgaacacatttataaggtttcctttgaattttctgccaggtaatcaatatacctccttttaatttgtgtcagtttctagtgctttgctttgttacagaatttggactgctttttttctctttcattattattatcactttgtacattctctgttgctttctgctcattagaaggaaaagccatggtaaccactcttcacagaatatgctcagggcaaatgccatcacctgttagcccagtccatgatagtggtgtctcttaaaatttcatactggtccaaactttttgttgttgttgttagtggcactcagacctatagaggattttaagttttcccctactctaaattaggtggcatcaaaattcatcctgcaggcagtctctgataaagtggagaaattggacaaagttttagcatgtatatggttcataaaaataatatgagtttaaggttttctcagccagttgctacatattgatattttataatcatttctttgaatgtctctggagtttatcttttgaaaatttagatcagaatatataccaggtttgaggcttcttgtctggcttaacgatctcctataggtcagcgtgtgaaaaggcacagagtctatctgaagaggagaactcagggaagccccaaaacaacagaggagacaaaactgaggactttgaggaatctaaagcttctgggacctgcagcctccagacatgctcagcaccctcttgttatccacggactaatttctttctcttttctgagtggtattttctagggttcccgtcctccactttgacactttggtatgtccatgtgtgtccattgtgtttcagccagggacacagaaccaggaaaacatcatggcttttctagagggagctgacctgggtaatcaacagttggagtagaaagtgcctttgtccatgtgtcacaggcctaagggccatgggcaggaggtcaggaagagaggatgaccagacggctggggaaaccaggatgaacaaagccactctccttcctggtgagaaggggcatgtggaagcctggtgtccctgtagggctgaaccacactcacctgcccactgctacctgccagcgaggtgacccacagagcagcagcagctcctgagtcactcacagaggctgcctcctcctccaaaccctccagtgtatgtgcttccataagtgtgagccccagcagatcccaaagttttcaatgggttcatctagctagtgtctgtcctcagccccatccccaggctcctgccctggttggtgtccacagtgtcccagcagcggtgacagtgacagccagggcctgcactttccagagcagcaagtttggaagaatcaagtcccagaaccagcctggatttggggcaaacacacaaatttcactctgaggggaagtgctggaaagtagccttgagtcttcctcagctcacctgtggctgatcctctgcatcccatcagcgatacatgagccctccccaaccccagcgtggagctgtttcaatcgcagcaggatgggaatgtgtcttctttctggggactttttaagcacagctcttatgttcctgagatttgaggtttataaaggtgtgtcagtcacccacagagtggacctgcacaagtaagacaaggacaggatccccaggagaggcacctcatatgagacgggacaggcaggtcccatcacagacactggtcctcagaaaccctgaccagctactcaccttcccaggtcacctgtgtctgatcagttcctgtgtttgctcctgaaaagatccccatcaagggtccccaggtcctgcccccttccttgatgtgcctctgggagtggggctggctgggctgtgggtctgctgtgactttccccacaggtcagcggctcagtgcaggctgcgccaactcggtggggctgggctgtggccgaccctcccagggggagcctggatgcttctcgggggcatctgcaggatcccaggttctgggagaacagggaagccacagtgtgtgcagggccccatctccaggtgtaaagtgtttgctgtcactctgttgacaagggcatatccccaggcctaggggcactgtgggtgcacaaccaatgtggtagacacagagagtaaggcacatttccctcccattactgtggggaatctaggcactgtgtgtgtgtgtgtgtgtgtgtgtgtgtgtgtgtattaggagttttgcagtgggctctgagccccgtgattttgtaggtttagaaattatctgatgagatgttcatccacaggaaccgacaagagattaggtgttctcccaaagcccctgggagctcctggactcattgtgagtgtggactgatccattgcttccagagctccacagaaggggctccctggtggtttcatagaatccttgcttggggtctttctgcagagttcactggctttcctacggccagtttagtattgtaagagatggtgtcagcagcacatggtatcacatgtcactaaatgagcattctgagccaggacacagcatcttcatactggggggagggaaatgctttgggagcccagacaggagcctctctgcagtgcaagggctgggctgcagggggcgctcaaggcccacccatcacaggctccacccccagagcaggtgcaccggaggctggggagggattcctctcaagatctgtgtcattcttctaaaaaaaatctaaaatgagtatttgacaaagactgctgaacattctataaatatcctattcaattgtgagcatttatcaaatttgatgttgtaatgagaaccacttttatactagatatttctaaccctgctagatatcttaatagtatgcagctggaggttaagcaagcttttcttttatataaataagtgcaactttggagaaacacactcatcccccgaataagacattcatgtattaaagcctagaaatactttaaattacctctgagccattcaagtgtgtgttcacagtgaagtcctgttctagggaaaattgttctccagggggagaagctttgtcaacatagagcttagggatgtatcaggaggcacatgacctctaaggggattatagcttgaacccttagcatcctcctgttggtaatacatgtgtcactctccaatctttctcatgcagtatcaggtatgaaataggatcgctcatgaatatgcaaataactgaggtaaatatagatatctttgtgccttgagagcatcatccaacaaccacaactctcctcagaagaagcccctagaccacagcacctcaacatgtactggacctggaggatcctcttcttggtggcagcagcaacaggtaagggacctcccagtcaccgggctgagagagaaaccaggccagtcaagtgagacttcacgcactcctgtctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacgtgcaagaggcacagtgtggaaacccacatcctgagagaaccagaaatcctgagggaggaggcagctgtgctgagctgaggcagtgacagggacaacgtggctgcaccctttgttgacatagggttatacacatacatatatatgcacccaacactggagcacccaggtatatcaagcaaatacaattagagataaacagagagatagacccaataccataatagctggagactttaacaccccactttcagcattggacagatcttccagacagaaaattaacaatgaaatcttagactaaatctgcatgacagaccaagtggacataatggatattgatggaacacttcatccaatggctgcagagtacacaatcttttcctaagcatatggatcattctcagggatagaccacatagtagaccagaaaatttgtcatttttaattaaaaagatatcatgtaccttctctgatagtaatgaaagaaaactaaaataataagaggaattttgaaaacacatggaaattaaacagtatcctccttaattaaacaatgtgcttccaaactgaactatatgctctaaaatgggttaataaagaaacaaacaagaaaattttacaatttattgaaagaaatgataatgaaaacagcgtatgaacacctatgaaatacagtgaacatagtactaagaggaaagttcacagctataagcacctatgttaaaaaagtagacaattataacataaacatcttaggaatatctctcaaaaaaaactagaaaagcaagagcaaatcaaatccaaacatagtaaaataaaaaagttaagatcagaacgttaataaataaaattgaaataaataaaacaataccaaagatcgatcaaatgaaaagttgttttttaaaaagataaaagacatctataaacctttaaccagaccaagaaaaaaaacaaagaagaccaaagtaaataaaatcagaaagaaaactggaaatattacaaccaatagtgcagaaaatcaaaggatcattagaggctactaggagcaactaaatgccaataaatcgaaatatctggaagaaaaggataaatttagagacacatacaacctaccaagattgagccaggaagaaattgaacagatcagtaacaagtagtgagagtgaagccataataaaaggtctcccagcaaagaaaaaacccgggacttgatgacttcatcactcaattatgacaaacatttaaagaagagataatacctaatctcactcaaaatattccaaaaatagataaaaagtagataaggaagggaagaattcttccaaacttactgtacaaggccaatgttacccttatatgaaaaccagataaagccataccaaaaaaaaaagaaaactacagttcaatatcactaatgaatatggatgcaaaactcctcaaggaattcttagcaaaccaaattcaataacatatcaaaagagcattcatcatgaccaagtgtggcttatcccagagatgcaaggatggttcaacctatgcaaatcaatcaatgtgacacatcgtatcaacagaatgaagggcagaagacgtaagatcaggccttaccttgttctcctcactcaaagtctaccattagttctttggtcctcttgaccagtcctgctgtacttggtctcccgtgattctgttcccaggtcctgaaacactgggcttctgcacacctggagtctctctctttgaacatggagaccctgtatcctcagagagggatgatgcctcattgtggctcccatgccccatgcaaacaattcttccaacacagtcatgatttttcctgttggaaattgaaaggggatgtgggaattgatgtgtgtgtgtgtgtgtgtgtcctcaggcctgttgggcctgttgagaacacagcagggctctatgtacaacaggaaagcaatgttttctctataccatctattttcttataaagtgttcataggtaatcaaaaggaaatgaatcacagtttataagatgttgtggactggactgatgttgtcactcaaggctactatgggggctccaggaaaagaaacctagaaaaggataagactgtgagcaaagaagcaaaacctgggaagcagcagggagagggtgagcaggggtgactcaactggggagggataacaccacttaccacagagggtgaaaactccgtgctcagcaaagaggagaacttactcagcatttcccctaatcctccctccagaagcgcgactgccaggaaagttcacaatgtatcatctccagctgggaacccaaaagaaacaggagattttagggcataggtcctgggcacaaggtgtttccctggttcctaccccttccctctctgtccagcaaaactgcttgtttctatcacttgccttcctgtccttggggtaagaatggatgctttgacactcagcagagggatgctctttcagaggaggaatgagtttgtgttatctgatgtctgagcaggacactcacctctgggaagaggctccaagacagaaggtcgccgtggttcctgccccttatatgtgaggggctcttgacacatgcacacttttcctcaaactctgtttataccccagcaacaatgctgggtgttgtcagcctctctcctccccagatactgctctatcatcagcttgagcacagtttccccatgaaaggcattattctctctctcaagaagatcaactttttacatgtcttcgatggatgacagtttttctgtgtgagaatctagaaataagaaatggggtaatggggacaagtgagctctctgtgtgactcactaggaagtccactgttattccaggtgtcctgtcccaggtgcagctgcaggagtcaggtccaggacccatgaggccctcagacacttccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgtgaaagactcagtgaggaggtgtccttatgagccctgacacaaacctgtcagggcacttaggacctccaggaagactcaagaccaccaaggggactcacgaccactggggaagggcaggttgcagtaagcacagggccagccccagagcaggtgcaggtggagatgagaggctggtttactgccagggtctggggctgcttctccatttagatgtttccttcagagaccctcccttatttcatgatgctctgcttagctgtaagtctctgaaatatcacagttttgttgtaccaggaggaaaccttctctcaggtgctaaatgtagaacaatctctctgccagtggttgccagggtcacagccctgtggaagctgaagggtacccagtgagtcttctccagtcacattcaggacaggaaccttagtggggttccctgaggagaacagtctttaggaattctaacctcagccaagagaggctgggccagggtcagtgtcaggtagaacctcacaggatttacgtctgacccttctcctgacactaaagcatgcaaatcagtatcagcactgatctggggccccttttgctcctagcccattctatttcttgttagttgtatttgttgttgattttccttttgctgttcctgatccctgtaaagtggagatgtggttcctgctgtaaaaattccagggctcaagccctttccctgcagctcaggtggggctcagactgtggctcctgcaaccacgtgggagaggctgatgggactatcttctctcccgttgctcagaaccctccagtgtgttgtgtggagactcacctgggaatgcaagtggccaatagttgtgaaaggtatgcgcttgtttggtcaaagtggaatgtggatgtggaatttatcctgtgttgtgcaaactaacacaggttcaccttcctcacctgtagtgttagaaagagtgtgaaagttgtaagaatcaaaacagagccacttgtgttaacaccctgacaaatggacctaggaatgaacatgaaggagggttcttaggcccatattcctgataacaaaaactatcataaatagactctgcttagccaccatcttggatagaagcccaccacaaccttattaaaaattacacttgcaagaacatcagctcagaaactggctgttcaaccttacactgatgccaccattgctattgattctacaactatatgataattatctcaaaacaacttttgtaacccacctcattttcacttcataaacctgtggattgacatgttggagttactgctgcatttgtagataatgataaataataaggccttttaacaatgtttgaagctgctattctctgatgtctcttctaaaataaagaatttccaagtggatgacaatgaaaaaattgttagaaatatttggtggtaaggcatctttaacatcctgttgaatgtttctgcatagcacatcaatcccttaaaatactttgctatatctgcatttaatgaatgagtctaatattgaggtgcaattgaaaatacctgggcctttgatgaatcagctcatagggtgataatgtctgggtccttgagaaagcagaccctgtgttgtaagttttagtagaagtaccttttgcaaagaaagttcatgtgtttctgaacattatgctacttttaacttaagaatgcaatatatgatttatttttacttcaaactgggtatatacccagtaatgggatcgctgggtcaaatggtatttctagttgtagctccttgaggaatcaccacaatgtcttccacaatggttgaactaattttcactcccaccaacagtataaaaatgttcctatttctccacatcctctctagcagctgttgtttcctgacttgttaatgatcaccattctaactggaatgagatggtatctcatcgtggttttgatttgcatttctctaatgactagtgatgctgaacattttttcatttgtctgttggctgcataaatatcttgttttgagaagtgtctgttcatatcctttgcccactttctgatggggctgtttgttttttccttgtaaatttgtttaagttctttgtagattctggatattagccctttgtcagatgggtagaatgcaaaaattttctccgattctgtaggttgactgttcactctgctgatagtttcttttgctgtgcagaagctccttagtttacttagatcccatttgtctattttagattttgttgtgattcatacttggttaatttttaattgcattgttttcttctgattagttgtaagtatacctgcatattgatcaaaaaagccgtttaacaaatcaaaaggaaacatttaacaaatacgtgacttggaagtattttctccaagtctgttgttgtcttttactcccttgtcagtgtgtattgcagaaaaatatgtatgtgtgtgtgtgtgtgtttacaaattaaagaaacaggtataatttcatttatccatagatcacgtctttggcattacatctgaaatctcatcataaaatatactaatagtgatttttttttccatgtctctaatctcaggccacaatctactcatgagtgtttaaacatcacctacttgattagaggactatcaccctaagatatttggaatatttctggaaggagatgtgttctttttcccattatttctctatttagtcatttattaatatccgtattggtttatgaatgtctatttcatactctgaagtaaatccatgctatattattcattttattgttcaaatcaccacagctttattatgtgcttggaactcatttagtttggatgctgcatccttacagcacacctcatcattttgtttttgaacactttcctgtttcctggtattacaatacattctaagcccattttctatattaactttttcatacatagaatcagacatttttctaaagattgcttctttctgatgttaaaatatagtattaaaataaaatttgtgatactgggtatatgtgttgttaatgtggtataagtacttttaggacctctcaaccaactggcctagtaaatgtgcatgtttatatgaactcatgtttaaggacacattgaaactatttatgtatcttatattctgtaactttattacattaaaaatgagaatacactggtctcctcacccaactatgttaccaccatatcgacctttctaggcttccttgactgtccataatcacccactgcaaagtgaggaaccccatcccatcatatgccattgtattacttagctgcacaatttcaggacacatgcattgcagcatcagaaatgtaaagctgtacccttcttggaaccatttttatctactagaatagagtgcttatgtgcagtttctttacactttaaacttatagaatttcctcattttcaaagttccttagatcagcaacttcgttttccactttcttcatgaagtcatttcaattacactgtataatttctttatttgaattctgtaaaagccaaaactacagtcaagtaaacatagagaggatattccaggaatttacagagtgggtatcaaataagttaaaaaggcaatgtttaagaagagtaaaactatttttagtgatatgcaatggttgagacatgacacaattaatttgtctaagctcataattttgtgatgaaaaatataaacctaaatatatacaatttaaaatgatgtttagcagtacattatccctaggatcaaatgcagactgtataaaattatctaataacttatttggtgaggatgccatgagacacatgcaacaaagaatgaactaattttccttatttgcatataagatgttgacattcactaaagatctttaatttaaaaaaaaatcaattttctatgtgacccaggttttttcttccagacaagcaaataacccacaggattattttctttccttgattgagaaagattttccccaaacttcagctcagttcaggcatatactgtccctaaatgggcatttaccctcagatgagtccacacacctgtcaacacgtggagtcttctgtcagacaaacacacctttactgatgtggattcttccctcagacaaaaacacatgtccccacatggacactttcctcagactaccatgtatgtccttacatttacgctttcctcagaaaacagacttttcctcatgtggactcttgtctcagacaagcaaatatgtctccatgtgaactcttcactcagataagtacacatatgtccacatttactgtttccctacacaggcacatatattcaatgttgaattgttttgtggcaaaatgatctcaagataatggtaattataaaccccctccctaataaagtgtagatctgtattttttttgttgtaacctaactttgccttattgtcaaaaacagtaatttgcagctctaaatgcaccagttagagacaggtgtccattttctctggaaatgtatttttattttcttactggacatatttgttgataatgttgctactatgaagatacctgaacagtatccacattaaagaataaaaaagagtaatgggcagaataaccctgtgcatccagacccagaaatcctttgaccctgccctcccgaaatgtagacacagaggatggatgagcagtgctgagcagtgtacccatgaccacaaacatgaagacatggaaatgtgtccccactcctcctcatgaaaggcagctcatgccctcttccttcaggccctggtatggagccaccccatgtctctgcccttccttagtgtccacaccatggggtctgcactgatctggattcccttctcatccccctcaatattagtgtgccttgtgaatcaggtccagctgtggctgttctcagtctgtttcctctgtattcacagaagtcctgtgtgatgtttactgatggagtcagaaggagaaaaatttaacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatattacagtgagggacacaggggagggaagatctgtctgagcccagacacaaaaatctctgcagagagacaggagggaactgcgtggtagatgctgctcagaaccaccatggggtggccaggaaacaaggggtgcttaggacctctagggagcgctcaggacgccaggggggtgctcagaaccactaggggacgctcaggacactaggtggcgctcaagacaacactactgcactcatgtcaccacggggtactcagaaccaccagggggcgctcagaaccaccagagggcgctcagaaccaccaggtggcgctcagcaccaccagggggcgctcaggacaccagggggcgctcagaaacactcggggacgctcaggacaagagggggtactcagaaccaacagggggcgctcaggaccaccaatgggtgctcagaaccacaagggggcgctcaggacataggtggtgctaaagacaacaattctgggctcaggtcaccagggggcgctcagaaccaccaggggacgctcaggacatgcaggttctcttaggaggcagctgcacatcaggagcttcagaggctgtgatttcctttcagaccctggaaattcctgacctggtcaagcaaaagtcttccccaggatgtctgatttttccttttaattccatgatttcttttacctacaaaacactaacttagaacagggatgtaatgcaacttttattgctgcgtattttctgagtaatactagcaatgatctctcgggacaattattaaaataggttatttatatattttaattattaaaaataatactattattaaaatagtaaaattttttaaatcacacttgtaatcccagcacttggggagactgaggcagacagattacttgagctcaggagttttagaacagcctggcaacatggtgagatgctttctatacataaaagaagaaatagctgagattggtgcaaccagctacttaaaaggctgaggagggaggattccttaagcctgggaggttgaggctgcagtgagctatgattgtgcctccacacaccagccttggtgacagagtgagaccctgtcttagaaaaaaaaatgcatatcctcaatacagactatttccatgaatagagttttgtgtttttgtgctgtaatagtcaaacaattgtatatgttttctaactttaactcagcatatgcatggtgttttgtttctttttctttcatctgctgtttgtggaaaataaacagcactttaaaggctctgtttctccactttgtttggcttccagtgtcctgtttttcagactgtttctccaccttcccttcttctttgaaagccatttatcttcctcagtctccatgcagaaaaagaaagtccctttactttctgtcttccaagtctggtgaatcagttcccttcttttcataatcactgaagccaaccaagtttagaagtataacagttctccttagaatacgctcatctacctgcactctctgccctcctcatccttttctaggtccctccagacatcaccctcatcccataccctcccttccttaagtaccacagagtgggctcttcacctcctgctgccctctatgtgctcagccctggggctcactagtcctttgattatgaagtccaaatccctatgtgcttgcacactctcacgccaccctctaggaagctgccattgtgagagagtcctgaaaagcatgggctgggtttagtttcataatgcatattatggtcaattagttattctatttgaacattctatttaattaatagatagagttaattaaatagagttattctatttaattctattaaactattaataaattagttattcaatttattaataacaggccaatatttaaaataaataccattgcacgtttaagtgacatatttgacaataattgcatttacatacagttttaccaaaacatgtatcgaagtgtatttgtttttttaaatattggaataggcagacatacacataggaaaacattattttgtactacaatctcaaactgcaaacacaatttaaatgccattaaataattagaataatatgaaacaaatgggcatggtgttttggtgtttaaatatacattcatttcacctgatcatacttatgtgtctttgctgggctgctgtgcatgtatgtgtatttgtatgaccatgaagctttcagatacatcattaaattacataaagtgttaccatgcacttccctcttttaggggacaaagtaaatctttcagggcaatcgcagggaaaatgtgtggttggatcttccacacagagtccctaccatgacattgccaagtagagctatggaagggggctaccaacctccagaccccagaatggtagatccacaggcagcttgcagctcgagtctggaaaagccacaggcacccagctccaacccatgagagcagccttatgggctgcattagggaagtcacaaaggtagggctgcccaaggccttgggcacccacccttgcaccaggtcacaagacatggagtcaatgattattttagagccttaagattgaaggactgtccgactaggttttggccttccataaaaatctttacccaatttttgggccattttctctttttagcataggactcctcacccaatttctgacccatcattgtactttggatgtaaataacttatttttgatttttcagtctcataggtgaaaggaacttttccttgagtctgaactttggattttgaattaatgccaaaacaagttcagattgtcagggaccactggggagggattattgtatattgcaatgtaagaaagacataaggggcagaatgatgtggtctggatgtgtgttttctccaaatcttatgttgaactgtgaaccccagtgttggaggtgaagtctgctgggaggcatggcattaggggcatatccctcatgagttacttcgtgtcatccccttggtgatgaatgagttatcagttcacatgacagctgattgaaagagcctggtaccactcccttctcttatcttcccccctattgtcatgtgacactcttgctccccttcatcttctgccttgactgtaagctttctgaggcactcagcagaaacagatgtcagcaccacacttgctgtacagcctgcacaactgtgagccatataaaacctatgtcctttataaattatccagcctcaggtatttctttacaattcaataatggacgaacagaagaagtatttaattgtgcagcaaattaggggtgtggaatcattaaaatggacttaacgcctgtagaggtaaagacacaagagtctctctctctctctctctctctctccttgaacccttctctgtctttacatacacacacacacacacacacacacacacacacacacacacacacgctccacgtgaagatgtcatgtgaccaaatagcaatatggtggctgctatgagccaacagtagaagcctcaaaataaaacctatcttgccagcatgtttatctttgaatttccagaattgaggaactgagataaaattaaggttgtgtaagttaccaagtatgattgtttttaatgtttgaactgactaaagagaatttgggatgaagaagtggggttctgatgttacaattatttcaacactgtggaaagtgccttggaattgggttatgtgtaaaaggctggatagttttgacatgcataaagaaatttatatattaagtgtcattctgatagattaaaatgagtagagtgctattggaaactggataaatggtgatctttgttataaagtgacaaaaaaaacttgtctagactatgttgtgatatttagtaaaagagaactttgagcagcaaaattgaatatttagctgagaacacttctaagtaaaatgttgaaagtgtagtttggtttctcctgggcatttataataagaaatagatgaattgaaaatgaaattataagggagaaaatatccaaaacttaaaggcttggaaaattctcaatctatctgtgttgcaaaaatcagaaagtgcgttctgaagagaacagtgagtatgaggctgtaatatcacttgataaagaatttatggtattaaaagagaataaatgcaggttttaaagaacaaggatggagatgagacaaaatggacgaatactgtcagattcttcagatttaagaggatggagctacttggttgcaaatgtgcaccattcttccagaacaaagaaaaataaaccttgaatttatttagaagtaatcatgaccactaccttggtttcaacagaccagaccatccatgcttaaaaccttgaggaaaagacctcctaccactgcctggaacttaggaactcccagtgagccttgtgtgtagggctgcatggggtctttgggatgggaccttaacccagcagttacccattggtgcctctacttaaagcattggaattaattctgctgctgcaatgagctgggaaagaagaagcttggcccagagaagattccacttgagccttaaggtctatggtaatttgttttgttatgtgttgtacttgctggggacacatcacccctcctttcttttctatttttctctttgggggagaaaatgtctattttatgcctaactcaccactgtattttgaaatcaaataacttgtccagcgctatggactgaatgtgtatgcaactccaaaattaatattgtggaaccctaatccccagtgtggtgtaattggggtgtgggccatttaaggggtgatcaggtgaaaaggttgaagccgtcataaatgagattagtgctctaataaaaagtcacgggagagcttttctctcttgcttccctgtcatgagatgatacgataaaattacggccatctgcaattcaggaaggaaacctttacatacacatgattggctgtcttgggcttcccagcattcggcactgcacagaataaatatgtcttgttaaagtcatgcactttatgacactttgttaaagcagccccaataaaataagatatctggttttactggctcagagttggagagaaatttgtttcagaaataattctacctcaaatcttactcatgtatggtttagttaatatttaaattatgttttaaacttgtttagagttgatgatgaaatgagttaagagtttggggactgttataatcaaatgaatgaactgcgaatgtgtaaatgccatgcatttgggggatggtcttttctattctgggtctttcatgcctacgtgtgaattgaaggattgcttttcttatttctgtgaagaaggccattattattttgatagataatttatctaatctgtaaataactttgggtagtatgaaaatttcaatactattaattcttccaatccataaatgtggagtatctgggatatatgtcctatttatgtgtgtccatttcattttctattaccaataatttatagttatcctctagaaatctttctcttatttggtaacatttattcctaggtatattttgcagctattgtaaaaggaaaggcttcatggatttcattctcagatgttttgctgtcaacatatagaaatgccaccaattattgtatgtagatgatgaatcttacaactttacttaatttgcttatgaattctaatagtttgtgagaaggctttagttttctttttttaatataagatctttttgtctgctcacaggaaatctgacttccacaattccaaatttgaggtcatttccttttactgttaactaaatactctggctagcatttcagtactattctgaataaaagtgataaaaatggttatttttgtcttcttccacttcttagatgaaaatttcccggtttttccatgcttcgtgtgatgaaagctgtgtttttctcatatatgcgctttattttttgagatatccttcttgtatacctaatttttgataatttctatcagaaatgaatgttgaattttattctatgattttctaaaatatcttgactacacaataacacagtaatatgcaggtcaatacatatcaactgaatttcacttaatatcatcccaacttctaatatttattttttagtattagaacatgcctgtttccatattatatttgctcacaggtattggtacatattttagctaatttgtcattattttactctaagaaataactcaaaaaatcatttttattatgaattgaaaggtaacatcggcaaaattagcccaatcttaatctttcccagactttgaaacattattgaagacaatgagaggggaaagtcagctttagttgagcttctaagaggtaagtgaggtaaaaacccagggcttattggctacgactttgaatgttactgtcttcttttccataagccacatccagaccattttctaaatctaagaaaactaattttatctcactgcttcttagtcttgtttcctgcagctgacaaccaaaactgtcagcgatagagcccagtgtaaatcaccagcctttaattattgcagaactatgattttacaacaacattgtgagttacataatgatcctactttatggccgcggtgcaaatgcttaacttccactaaatcacagagctcagaatggctagcatggaggtgtatatgtatatgtgcattgttctagaaatttccaattactgtatattattgtttgcagtaattaggtcaatctgaactgacaaaagtctccatggccttataagcacagagaccacctccacggcaggtggaaatcaaggctgggaacagtctaccagctgctcccctgggattcctccaattaccctgtttaaagcctctgctcactcatgcgctggaagagggatgtcagagatgcagtctactcttcctaaagggctgacagggcataaagacaagactgattatccatggaacattcctataggaatgcacctatgtgcagacacactaataagctgtgtgtcttgcagtgtgtaaatggctgagatgccatttacacttctttacacaatacatttttaaatgttttgttgatgtattctctatcattcaaaaaaatcatcactttccccctaaacaaagaggatttttatcagaacacttatgggaagccccttgctctcccagattcccaccctcatttctcctgaaggaagaaagaaaaccatctctattgatttccactctcatcctctaggactaaaaccagaaagctgcatgctccctgggtgagccttagagaagaccctgtctgtaggagcaggaatctcagagccttggctgagaggcatggtcctgaaatgagatggagtcccccatggagatcccacgtggacgcccacacctgagggctcactgctcctcaccacagatgcactcccctactgagtcctgagacctgagtgcaccccatagagtaggactcagatgagggaatgcaaatctccaccagctccaccctcctctgggttcaaaagctgagcacggggcctcgctcagtgactcctgtgccccaccatggacacactttgctacacactcctgctgctgaccaccccttcctgtgagtgctgtggtcagggacttcctcagaagtgaaacatcagttgtctcctttgtgggcttcatcttcttatgtcttctccacaggggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggataccacagagacacagcccaggatgcctcctgtacaagaacctagctgcatctcagtggtgctccctccctacctctgcagaacaggaaagtgtgactgagatgccatttcctgccagggcttgtgtttcctataccaaccagactcagagccctgtctgttttcctattctgtactattaaatggcatgttccctgttagtgattcacgcaagcagaggctgtatcctgtttgacaaagattgagcatgaaagattcccattacctgggccacatgcatcactgatatgtggccacttatttcttgagctcatatccttccaaggggctgaatacaaatatctataacataggccatcttaaactgcaggaagtaatgttggagaagaatgtggagataaaagagcaggatgattaattaaaatccagataccatctttttttgcagagaaaaatttacactaataaagtaattttatgaaacaacaagaaagatggaatgtgtcctcatcatggagtgtctcacttgcagtgcacaaataaatttctaaaaattttatagggaagatgtgatagatgaggctgatttccacacagggagtgattaaatacccaggtaagtataaaatccaacacttggaaaggaaaatgcctcagcttgacatcagaaacccagctcagtaagtctgaggagcaatgcggaaaagaaatgaaaaattcgacaacacttttcttatgaaatccctagctcatgtttgaacacgaaaacagaattgtccacaattttaggacagccatcgcatgacaacaaaccactacaatgataggagcatcactgagtcaacggagttcaagcagtgagcagatcagtactgaggccccaggagaaccaaggctctttggtacattttacagaacccagaaccgagccacataatctatggccaagtgatctttgacaaagttaacaaaaattaaccaacgtatacaccagggaaaggacaccccattcaataaagggtgctggggatattggatagctatatgcacgcgaatgaaactggacccccaccctcaacatgtaaataattaacacaaaatagattaaaggtttaaatgtaagtcttcaaactgtaaatgtattcaaataaaacaccaggacaactcttctggacaaaaagcaaacaatagacaaatgggacttaatgaatctaacaagtttcttcacagcaacagagtgaacagacaaagtgcagaatgatagaaaatatttgcacactgtgcatctgacagagtactaatatacagaattaacaagaaactcaaaccacaacaacaaaagaaaacaagaaccaaataaccccattaaaatgagcaaagaacatgagtagacatttttgcaaataacacataaaaatggacaatagatatataaaaatgctcagcattactaataatcagggaaatgcaaattaaaactagtgagatataccattcacaatggctgttattaaaaagtcaaaaataacagatgttggagaggatgaaatgtaaagggaactcttagacactgttgatgagaatgtggacgagtacgacctctatagagaacagtatggattcagtatgatattgactgtgcatttgtcataaacagctcttattattttgagatacattccatcaatacatagtttaatgagagtttttagtattaaggggtgttgaattttattgaaggcctttgctgcatctattgagataatcatgtgttttttttccattggttctgtttatgtgatggattatgtttattgatttgcatatgttgaaccagccttgcatcccaggtatgaagccaacttgatcatggtggatttgaaaaccggcacaagacaaggatgtcctgtctcatcactcccattcaacatagtattggaagttctggccaaggaaatcaggcaagagaaataaataaagggtattcaaatagaaaaagaggaagtcaaactgtctctgtttgcagatgacatgattatatatttagaaaaccccatcatctcagccccaaatctccttaagctgataagcaacttcagcaaagtctaaggatacaaaatcaatgtggaaaaatcacaaacattcctatataccaataatagaaaaacagagagccaaatcatgactgaactctcattcacaattgctacaaagagaataaaatacctaggaatacaacttacaaaggatgtgaaggacctcttcaagagaactgcaaaccactgcccaaggaaataagagagggcacaaacaaatggaaaaacattccatgttcatggataggaagaatcaatatcgtgaaaatggccatactgcccaaagtaatttatagattcaatgctatccacatcaagctaccattgactttcttcacagaattagaaaaaaactactttaaatttcatatggaaccaaaaaagagcccatatagcctagacaatcctaaggaaaaagaacaaagctggaggcatcacgctacctgacttcaaactatactacaaggctacagtaaccaaaacagcatggtactggtaccaaaacagagatacagaccaatggaacacaacagaggtcccagaaataatgccacacatctacacccatctgacctttgaaaaacctgacagaaacaagcaatgtggaaaatgatcccctatttaataaatggtgttgagaaaactagctagccatattcagaaaactgaaactggatcccttccttacaccttatacaaaaattaactcatgatggattaaagacttaaacatgagacctaaaaccataaaaacccaagaagaaaacctaggcaataccattcagtacataggcatgggcaaggccttaatgactaaaacaccgaaagcaatggcaacaaaagtcaaaattgacaaatgggatctaagtaaactaaagagcttctgcacagcaaaagaaactatcatcagagtgaatgggcagcctacagaatgggagaaattgtttgcaatctatccatctgacaaagggccaatatctagaatctgcaaggaacttaaacaagcttacaataaaaaaaaaacaaccccatcaaaaattggcggaaggttatgaacatacacttctcaaaagaagatatttattcagccaacaaacataaaataaagttcaacagcattggtcgttcgagaaatgcaaatcaaaaccacaaagagataccacctcacaccagttagaatggcgatgattaaaaagtcaggaaacaaaagctgctggagaggatgtaaagaaataggaacgtttttacactgtggtcggtagtgtaaattacttcaaccattgtggaagacagtgtggtgattcttcaaggatatagaactagaaatgccatttgtcccagcaatcccattatttggtatatacccaaaggattataaatcattctgctataaagacacatgcacacatatttttattgcagcactgttgacaataacaaagacttggaaccaacccaaatgcccatcaaagatagactggataaagaaaatgtggcacatatacaccatggaatactatgcagccataaaaaggatgagttcatgtgctttgcatggacatgggtgaagctggaaaccatcattctcagcaaactatcacaagaacataaaaccaaacaccgcatgttctcactcataagtgggagttgaacaatgagaacacaaggacacagggaggggaacaaacatcacacaacagagcctgtcggggagtggggggctggaggggatagcattaggagaaatacctattgtagatgatgggttggtgggtgcagcaaaccactatggcctatgtatacctatgtgacaaacctgcacattctgcacatgtatcccagaacttaaagtatagttaaaaaaaaagagagagagagagaaaggaaacagtatggagactttccaaaaaatgagaaacagtactggcctttattctaccaatcccactactgggtagctacccaaagagaaagaaatcatatttcaaaaagatacccacacttctatgtgtaccacaaatctattcccaatagcacatatgacaacctgagtgtccaccaacagatgattttataaaagaatatagcatatatgcacaatttaatactagtcagccacaataaggaatgaaactgtgtcttttgcagcaagatgcctagaactgggggacattataattagtgaactaactcacaaacagaaagccacatatcacacattattacttataagtgggaggaaaacagtgtgtacacaaggatatggagagagggattatggacattggagacttagcagaatgggagggtaggagttgggagcatgatgaaaaatcacctaatgggtacaatgtacgttacttgggtgttgggtacactaaagccaataccactgtgtaatatttccatgtaacacagttgcacccatagcccttaaatttatacaaataaagataaaaacaattacaatttaaaatataaaattattaatagttgaccaaagatcttgaaaattaaaatttaaatcatgatcaataaatgaaattaatatcagttgaacttcatttaacttaaaatccttttgtactcaagtgattttaagaaaatgaatgtcaagttttagatgaggagatttgcaaatcatatcaccacctatgtaattatagtaagaaccctcaaaactcaacagtgaataaaagaagaggcaacccatggataaaataggcaaaggtttgtgcaggcatttcattaaagaagatgtacagattacacataggcatataaacaggatctcaacaggatttttcatcacagaaattcaaatcaagaccacaataagatacccaaacaccctttttagaatggctgaaattaagaagaaagatggatcataccgatgctggtgagcataccaggtttctagagtctaaaacattgctaatgggaatgcaaaatgaaacagctacacaggaaaataattcttagtttcttgtaaaattatatatgcccttaacacattacctaaaaatccccctcctgtaatacagtaatacatggctgtgtattactgtgaaagaggcatagtgtgaaaacccacatcttgaaaccctgagggagaaggcagctatgctgtggctgaggagattacagggattatttgattaaagacttttttagaaagtgaggttaaatcagccgggcgtggtggttcacacctgcaatcccatcactttgggaggccgaggtgggtggatcacgaagtcaggaatttgagaccagtctggccaacatggttaaactccatctctactaaaagtgcaaaaaattagccgggtgtggcggtgtacacctgtaatcccagctactctgggcgctgagacaggagaatctcatgaatcggggaggctgaggttgcagtgagccgaaatcgacccactgcaccccagcttgggtgacagtgcaagactccgtctcaaaaaaacaacaacaacaacaaaaagcgaggttaagtcattgaaaaataggaaaatataaatgtgtatgcactctaattatttgggaaattttccatacaacttgtattctgtaaacaaaattcagggagtggaaaacaaatcaaattaataaaactgatataagaattcctctgaagatattagtgtgagcactaacacacacttttgaatgggtgttgtaaatattttggaacacacctcttaggtcacattttaattctacatttatgtaaattatataaaatatcgaaattttttaatgtctccattttgtgcagttataattttggtttcatgccagcaatgcatgatagattccgttcttccacatcctcgttgccatttggcactataagcattgtgtattttaaccattctaatctattggtggtgatagctcattgttgtttaaatgcacatgtctctaaaattttatatttaattattttatataattgtgatgaagtgtttgttatggtatttggctcatttttgatagcattgtttatttttgatcagttgtaagtttctttacatacccattatataagtcacttaaaaaagtacttagctggtcatgaaccccaggatgagatgcagactgtatagaaatctctagcaatgttactcagtgtgggcagggatggcatgagatacggggaataaagaataaagtaactttctccatttggatataagatgtgtccattcactagagagttttctttcagaaggttcccatgtgagccagtttccttcctgacaaggaaatcacccagaggattctcataatctcttaagtgagaaaagttttcctcaaactccagctcagtctagctcacactgtctctaaatgggcaattactttcagacatgtacacacatctgtcccaacgtggactcctccctcagacaagcacacacattgcaatgtggactctcccctcagaaaaccacacatgccccacaatgactccttcttcacataagcatatatgcctgatgctgaactgctgtgtagcaaaattagctcagaatacaagcacttatggactctagccataacaatgtgtagatctgcattttattttaaattctaaatgaacattttgccttcttgttaagaacagtggtttacagctctacatgtagagactacaggcagatatatgtttcctctgggaaaagtttattttcatgtatttactgggttattttgttgataaacattcatctataaagacacctgaaaagtgccctcattagagaaaaagaaagtgtagtttgcagattaactctgagcatccaatcccaggaatcctttgatctgccctccctgaaatccacaggcagaggggggatgatcgctgataagtagcaaacacatgtccacaggaagggagacatggaaatgtggtcactcccacactcaagaggagcagctcatcccctgtccgtagtggtcctggtgaggagccaccccacacctgtgccttcctcagtatccacaccatggggtctgtgctgatctgggcttcccttctcatcactctcaatattagtgtccttgcggatcaggctcagctgtggctgctccagatgaggctgttctcagtctgttccctctgtgtttgcagaagtcctgtgtgaagttcaccgggggagacagaggaaataacggtgcagccgggggctatctgagtctctcctgcaaagactctggattcaccttcactgattgcagcataagcttggtccagcaagctccaggaccagggttgatgtgggcagcaacagggagaaattgaagaggaagctctcagtggtgccctccatgaatacaaagaatcttcacagtccccaggacacccttacgtgcatggtctcactgatatctttacttcttttatcacttttgttatgtaaatcacaatgaatagtgtattcctcatctattatacatttgttaagtcttttttggtgtctttaaaaaaactgataactttatagtatgtaatatccttaagtcctgaaagtgttttttgatgtctaccttgtcttaaatttatacagctactatagcttttcttggttcatgttttctcatatttatcttttctatttgtgaatatgtagagaaactttcttgtacatagctaatagttgtgtattgcttttttattttggcagtccttaaatattctaattttttatgatactttaagttttagggtacatgtgcacaacatgcaggtttaaacaaacaacctcatcaaaaagtgggcaaaggatatgaacagacacttctcaaaagaagacatttatgcagccaaaaaacacatgaagaaatgctcatcatcattggccatcagagaaatgcaaatcaaaaccacaatgagatatcatctcacaacagttagaatgacgatcattaaaaagtcaggaaacaacaggtgctggagaggatgtggagaaataagaacacttttacactgttggtgggactgtaaactagttcaaccattgcggaagtcagtgtggcgattcctcaggtatctagaactagaaataccatttgacccagccatcccattactgggtatatacccaaaggattataaatcatgctgctataaagacacatgcacacgtatgtttatagcagcactattcacaatagcaaagacttggaaccaacctaaatgtccagcaacgatagactggattaagaaaatttggcacatatacaccatggaatactatgcagctataaaaaatgatgagttcctgtcctttgtagggacatggatgaaactatctattgcttttttaaatcaactataataaattctattttttttttttgagaaggagtctcgctctgtcgcccaggctggagtgcagtggtgcgatcagggctcactgcaagctctgcctcctgggtttatgccattctgctgcctcagcctcccgagtagctgggactgcaggcacccaccaccacgcctggctagttttttgtatttttagtagagatggggtttcaccgtgttagtgaggatgctctcaatctcctgaccttgtgatccacctgcctcagcctcccaaagtgctgggattacaggcatgagcaataaattctatttttaaaccaacaatatttttttccgttaatttttgtttaaattaacattttgtaatgatgcttatttctctattaacatggtatttaattacctttttataaatattgtatagttaccataagatttacaataaaaattgtatgtaattagattctaatgtaaatcctgtgatggccttgatatgaagaacacagatagtgtaactgtgtgctttgaattcctccttctcgccactctttcttgtttattctgtttgcacttacatatgctgtaaaatagaatatgtaattttttattactttatacagttatatcttatagcaattacaaatgttaaagagtacaattcatctagatttttccatttttacaatctttatttctttgtagagatttctattttgagtgcatatcacatggctactcgcagagaatctttgtaaaatgtgccctgaaacatgaatgtgctgacaacacatattctccagatctttttttctgacagaattttatttgccattcacctttaatgaaattttaatgcatgtagaatttcagtttgcatttcacctgtaatttattttcttgtaattattattagtttttcctggagatgatcacacattacattctgctgggcctttattaaccatgtttctgcgaacctagtcaggcttgggtttcaagtgtatggttgccgtggctatcagagttgaaatcagcttctcctgttcacaaaaacttcaggttcctctggtgatacctgcgtttgtgtccctgtttggctttggatcttcacatttcattctccccaaagaaaggctgtctctttcagctgtggcaggtgcatcctgctgacacatttacttggtgactttttgtgggatgaaggggcttggacacaggggcacgttttccaaccttctggctgagcctccttcttagctatgggtggtgagactggctctgatgcatgatcttccaagtgttcctgttccttcccttcctcagtgtcacagtgtctcttcccagtcatgctgttttttcatcagtgtcctcagcttctgacccactgtccttaccccacagattctggatttcattcctcaggaaacagacgggaggtgattctgggtagagtttccctgatgtcctctgtttccttgtgttctagttgattctaccagtgcccacaggacacaagatttaataaatgtctcctgcatataatgaagggggattcagcattgaacggagctactgttcttcctccccagtcaacaccacaggacagcaggtgggtgagttgtctggggatttccccaattctgtaggaaaagcctgcaagtgccaggagtttcacactctcacaccattagcacacacgtcttcaagcaactcattaaacatttccaggttagctttttcctatcttcaataccatgccatgagtggcacctgccccaggtactctaataaacgcaccctagttctctctgcgggcccctattttctcatatttcagggatttttttctctgtgacatcaactcagatatggtgaggggtttattttttgtaattcttcatgttttttgttaacgaggtcagaataatatcattttctcaatttttacattctaacgcttagtatctgatttctaaataaaattcagaaactaagacaacaaatgaagtatccattatttggtgcattgttaaacaatttgagaaatattcatgtactgaaatagaatgaaccactgaaatcaaggcatgcctcattcacataagaacatgagggcattatcaaataattttgctgagtggaggaagctaaagaattcaccatcaatttcatgtgatttcatttgtataaatcacagaagatgcaatattctaaattaacatagagaagatctgaatttctctgaaaatagggtgggcagagtaacaacgtggtgaaataaaattatagacaagttagataaaaaaattagaggttaacttaattgctaaaacatgattgaagtgctgattcaatgactgcacacatatatcaacattttccaaatgcttcactatcaatttgatttcattattgattgtttttttaataaagcagtaataaaaatgaatatattggctgagaaagagcaagaaatggataaataccgacacttgaataatcaaggactcctgaaaatacacacatgtgaacactgattgtagatttcaggtaaacactagaaaaggcaaaattacacaaagttgttatgacaggagggacatcctgaaaacctctctaggcatgtcccacaccaccctggagctgtctcaggggagcagtctcctccagtgtttagaggcacaggcacgcataatagggctaactctggccagatgtgtgatattggacacattgcacaactgctctgttctgtatgtaatttatcttctctacaaatgtaacattgacagttgcattaaatatattctgcaaatatgtaaaagttaaataagctgatgtctgctaaatgattaccaaggcacaatcacataatctgaagttatattttccagagtgataggattacctccagagttttccaggacactctcatctgctccgggcactgccttctcctcagccgtcccacccctgagcttgctatatagtaggagacatggaaatagggcccactctctgctgataaaaaccagcccaaccccgaccctgcagctctgggagaggagcccagcccccgaattcccaggtgttttcatctggtgatcagcaccgaacacagaggactcaccatggagtttgtgctgagctgggttttccttgttgctattttaaaacgtgatctatagagaactagagatattgagtatgaatggatatgagtgagaaacagtggatacgtgtggcagtttctgaccggggtgtctctgtgtttgcaggtatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccagagacacagtgaggggaggtcagtgtgagcccagacacaaacctccctgcagggccatgcgggtggtttcctttctcagctgcaggaggcgggcttattgttgcaggactctggagacttattaggttgtgatattttactatggttatttatcatgaacttttttattgggaattgtgttttattaatttttattttatatgtaaggttatttttttaaaatacataccttcaagaaataattcttcctaataatttgcacttgttctttttagagttttgttaacatctgttgatatcagctactacatagctatagggacattaatttacatctatagacatatgtgtaaatacacaaacttatacatatatgtggtcttttatatttaatgttataataaaattattataacaattataaaatacatcctaaagaatgaaacatatatagtaatccatattcctttcaatcattgcctatagtttacataaattgatgtctatttgtaaccttaaacatagtgtattggtcattttcaaacatccaagaacaaatttcaaatgtccttgtcacacacacaaaaataaaaatttgaggatttgaggtgatatatatgtcaatcagctcgattcaattattccatattgcattcataaatcataacatagctttattcactataaatacatacaaccaaaatttctcaattttcaatgaaattttaattatacatattttatctgtcctaggtcatgaatgtttttctccctgtccggatgtgattagattgtcctgagaaacaaattcagcttcctgcctcctgaaggcttcaggaagcagctcctagatggggtgaagcaggcaacccgtgtgtgtccacaggacccggagcctctctctccttggattaggccccctcctcaggattacagggctcttcagttttctcaacatgctgttataccagagaagcacaaaacacttaatttcattatatttttcttcaatttttcaaaacaacacaaaggtaataattttaacaataaacatattacaacctactatacatgagacccttcctgtgcttcgaggtttcttctcaggactttgtatgtattacatgttttcagtttttttctgagatggaatgttgacgtctccttattacagattattcttttaatttgtctcttagaataattttttccagagctcctgcccgcccgcgcctggcggaatggagcggcgccagggctgagccaggcgcgcaggggccgccgcacgtgccgcgcggggagcggatgcccagcgggcggagagccagcgccagaggccgggtcggagcggccgctggagcagcgtcagaatgggagaacagcccatcttcaccccccgagcgcgggtcttccagattgaccccaacaccaagaagaactggatgcctgcgagcaacaggcggtcaccatttcctgtttctatgatgtcacaaggaacagctatgggatcatcagtgtggacagcgccaaggtgaccataaacaacacaattacacagaatatgaccttcaccaacacgtcacagacgtctgggcagtgggccgacagcagagccaacacggtgtttggtttggggttttcctctgagcagcagctgacaaagtttgcagagaaattccaggaggtggaagaagcggccaagacagccaaagacaagacccaggagaacatggagccctcgagtaatcatcctgagaatcagggcgtggagccccatcttctactccggcatccagtgtcaacgggacggacgatgaaaggcctctcaggccgctgcagccgacacgcacctgcagtctgggaaccacaagctgaaggcggcctcgacgcagagctgcccacgggaagaggtgggagatggagctgcagacccggcgggagaccgacttccggctgcccacggcgctgcaggagtcgacggccagtgcggagcagaggaagaggccgtgagtcagagtgcgactgtgtctctgagaagatggaggcggcagagagaggatcaaaacctggaagataaagtgcgttccctaaagataggccctgaggagagcaaatcccgacagcgccacctggaggcgcttcctggtggcgctggaccggaagatccaggcctgcataacttccgcccaggcctcccaggctgggcaccaacaactagggctggcagaggcccgggatccccaacgtgagtcctaagtatgtgtgcgagaccagatggcgctaggacgttccctgtgtgcgttgcttctgtaaatgcaggcgccgtgtgtcgtgtttccaaaccagttgtgccatccactcactcctttccagaatagaaatctctcgcttctctggccttgtgaggttgtggacaactggaagattctgactgaggaaaccagaaccaggtctaccttcaacatttacgcagtcaggccagggatgtttatatcgttcataagggttgttggaaccatatgaactgaaaaaaagcattttctcatccaaatattgatattctttacaccaggccatcgggctccttttatccgatagcattcagagtatttgaaggtcctccaggtgccagccttgggggcacagggagaacaacattcctctccgaaaacatggggaagctttaaaataactgtttagtggagacttgcccagagatggaaaacaggtttctggtgagtacattttctggtttgggaatcacctgcatccccgatcctgccccgtgccccccagtttgtatggttgtgacaatgttccatttctttgttttaatttctgagcagttgactgtggtgcgggaacagcacacagtgagggtgcctagcacaatgcctggcgcaaagtaggtgctttataaatatttgttcaattaaaaaaaaagagggaggctgaggcaggagaatcacttgaagctgggaggcggaggttgtggtgagccgagatggcgccacttcactccagcctggcaacagagcaagactccatttcaaaaaaataaaataaaataaataaaataaataaataaaataaaaaatattttttccaagccccactcaaaaccatggtattgttagaggtgtaatagttggaccaacattgaaaatacattccatttagttcatgggcgtgcaaatatccttttttctttaaaaattgttctcagttgtaatattacaaaaaatattggtaatttataccaatgacacaggttaaaatgttgtataaataatttaatgacgtttgattggaaaaaatacatgtgccacatgtcgacaattttttccttctctatgaaatatatactcattaataagtttcagatgttacagttatctttttgatttctgggatttaattttagtaggtatacttgaatgcattttattaattcctataatgatgttgatatttcatgtaggattttaatactaattttactatttactgaattttaaactattctacatgttttatttatataagaaaaaaattacatatgagaaaaaatgcgtagacctgaaatgtatcactagagagtttctgtcaaatgtgaatacctttgttcccaacacctaaggtagcctgaagagcaagtccttccccacaacatgcgtctttttctgtgcttgcggtcagctcctgcatggggaaatgttttgatttctgacactatagatccattttttttctgttttgaactttatataaatgcaatcaaacattttagaccttaatttggtaatgggctacattgctattttttgaggttatttcctgctatttaaggtattaaattagatcaacatattatcatttattcaagtaatggactgactctgatatgaaacctcaaagttttcacatatatatggagagagagagagagagagagagatgagggagagaggttttatatctgagtcagtctgttaaataagtaaatgacagtattttgatttattttcctgtaaatcgactttaaatttgtttccagtttatgaatattataaacaaagctgttacaaatgtcttagtgtaagttttcctatgttgtcttccttttattgagaaaatatgaagtatgtatttattataagcttaaattttttcagttttattgaggtataattgaaatattttaataatgtatagctttaaggtgccccacttgacgttttgatgttgtattagtccattctcacggtgctataaaaaatgcctgagactgagggatttgagaaaaaaagtgtgtttaattggctcacggttctgcaggctgtacaggaagtgtagtggcttctccttctggggagagtcaggaaagttaggatcatggcagaagacaaaggggagcaggtgcgtcacatggccagaccaggagccacaggaagcagggaaggtctacacactgttaggcaactagatcttatgagaactcacacactgtcatgagaacagcaccaggagtttgttctaaaccattcatgaaagacccaccccatgtcccagtcatctcccaccaggtcccaccttcacaattgaggattataatacaacatgagatttggggcaggacacagatccaaaccacatcagatacacattgtgaaatgctcatcatggccaaggtaatttgtatatccattttctcatggagctaccattttatttttttaaaatgtactacatgtgtgtgtatgtgtgtgtgtctcatgagaacacctacgatctacccgttcagcaaaaatcacatttacaatacagcattaaatacaagaacattgcagtacattagatctgcagaactcattcaccctgcacaactggacctctacccttcgaccgacatcatctgatttccctctcctcacaggcctgggacccactattctactctctgctttcaagagcttgaatattttagatcccacatgtaaatgagatcattaagtctttctgcatctggcttattccactaagcatcatgtcctctagccccatccctgttgttgcaaatgtcagaatttccttcttttcaaagcctaataaaattcagttttctgtgtacacattttctttacacattcatcaatctgtggtcattaaattattttacaaatctacactattataaataatcttgcagtgaacatgtgtttgacataataattttatttcttttgaatatatgacaagaagtgggatcaccagagcatatgatagctttatttttcaatataatgaataaccaaacctaccacaccatgcttttgaagtcttagtcatattttatttgcctaggccaatgtcccgaaaaatttctcctacattttcttcagtttgtacatttaaatattgaatccatattcaattaatttttgtctatggtgaaaaactagaagtctagttttattcttctatgtgtggctgtctaagtttttcagcaccacttactgaatagagggttgtttctccattgcatatttttgtcagttttgtcaaagaacaggtggttgtagaaacttgtctttatttcttggctgtctattcttttacattattattattgttattgtttttagtagcagtaccatgctgtctttcttactgtatctgtgtagtataatttgaaatcagggaatgtggtgctttcagctttggtctttttccttgggatttcttttgctattcaggctgttttttgattccatatatatttaaggattttttttaaaacatgtaatcaattatattggttacttgataaaaattgcattgaatatgtatcttgctttggacagtgtattagtctactgtgcattgctataaattaatgcctgaggccaagtgatttacaaagaaaagaggcttatttggcttacagttttggaggctgtgtgagaagcatggcaccagcatctgcttcttgtgagggcctcaggaagcttacggtcatggtggaaggcaaaggggaagcaggcggtgtcctgtggtgagagggggcacagaagaggggaggagggtcgctagactgtttttaacaatcagatttcaaattagctaataaagaaataattcactaattaccatggggttgataccaagccatacctgaaggatcttttccccacaatccaaaaactcctactaggacccacctcaaatattttggatcacatttcaccatgagatttggaagggacaatcacctaaactgtagcatttcactcttgtgtcccctggtctcaaatccttgtaagattgcaaaatcatctttttttaaaatagttcccaaaagtgttaacttgatcaacctccaactgaaaattacaaagtctcgccagggtcttaaggcaatttccctccagctgcgtgctggcaaaatgttttaaagagttatgtacttccaaggtgcaatattgccattgggtaaatattgtcaatacaaaaggaataaattggccaaaggccccacacacacctaaagcctagcaggacagatattaaatcttaaagctacaaaataatctatcttgactttatgttcttagtcagggtacaccaggacaaagtgggtcccaaaatcctcaggcatctcatccttatggctgggcacattccatggggctaataacacaggccagagtcaagtgccagaagtagttccaggttgggagtacaagctgcctttggatctaccattctgggatcttgagggttgtggctgcatttctgtagctccactatgaagtgccctagtggggactctgaatggggttccaaccccatctttccccatctttggtactgccttcgtagaggttgtttgtggtggatccagtcctgtagcaagcttcctcctgggcacatagggttctctacacatcttctgaaatctaggtagaaactgcccagcctccttcactcttgcattctgcatatctgccagaatccagttatcccagcaccatttactgaacacagaggtttttttccacattgtttgtttttgtcagccttatgaagtatcagacggtttaggtgtgcagctttatttctgtttcctattttgttccgtttcttctgcatatctgctcttgtaccagtaccaagctgtttttgttaccatgtcattatggtgtagcttaaagttgggtatcatgatgcctctggcgttgttctttttgcttagcattgctttggctattcagggtcttttttggttccatacaaattttagaatagattattttttctaattctgtgatcaatgatgttgatagttttatgtaaatagtactgaatctgtaaattgctttagacagtatgataatttttacaatattccttcttctaatccataagcatgaaatgttttcccatttatttgtgtcatgtatgatttatttatttatttatgctgtgttttgtagttctccttgtagagatctttcaccttgtttgttacctgtatttccaggcatttcatttgtgtgtgtgtgaatattgtaagtgggataagactgtgttcttgatttcactctcagcttggacatagttgggtatagaaatgttagtgattcttgtacattaagtttgtatcctgagactctaccaaagttgtttatctattttagaattattttggcagagtctttagaattttctatgtgtagaattatatcatcagtttggacagatatatctacttcttttcccatttagatgttgtattagtctatttgcacactataaagaaacacctgagactgcataatttataaagatttttaattgtctcatggttctgcaggctgtacaggaagcatggctggggaggcctcaggaacccaacagtcatgacagaaagggaagcatcatgtcttacatggctggagcaggaagagagaggaggtaggtgccaagtacttggaaaccacatctcctgagggctctgtcatgggaacagcacaaaagagggtgaagcatccccatgatctaatcatccctcaccagtccccacctccaacactgggaataacaatttgacatgaaatttgggtggggatgcaaatacaaaccatatcagctccgttttattttttctattgcctggttgctctgactacgatttccagtagtatgctcaataggagtggtgagagagggcatccttgtcttatttcagttctcaaggggtttgagcttttgctcactcagtataatgttgagtgtggttttgtcatagatggctgttattattttgagttttttttttttttttttgagacggagtctcgctctgtcgcctaggctggagtccaatggcacgatctcggctcactgcgacctctgcctttcggggtcaagcgattctcctgcctcagcctcccatgtagctaggattatggttacgggcatgcgccatcacgcccagctaattttttgtatttttagtagagacagggtttcactgcgttagccaggatggtctccatctcctgacctcgtgatccgcccgcctcagcctcccaaagtgctgggattagaggcgtgagcccccgcaccaggctattttgaggtattttttgatgcctagtcttttgagagtttttatgagtgaatgttggatctcatcaaaagctttctcagcatgtattgagaaaatcatatgttttttgcttttattttgcttacatggagaatcacagttactgaattgtggatgttgaatgaaacttgccttccaggggtaaagcctacttgatcatgacgtatcacattttaaagtgcttctggattctatttgttagtattttgttgagaaattttaggtctatgttcaccaagaatattcatctgatgttttcttttttaattatgtatcttcctgattttgtatcccaaggacacacaatgaaggaaggacagtctcccaacaaatgatgtaaaaactggacatccatatgcaaaataaataaaattagaccttctctaacaccatatacaaaaatcaacaaaaataaacataacatgaaaccataaactcatagacaacatggaaaaataattcatgtcattgattcagaaatgatttatttgaagttaatcccaaaagcaagcccagcaaaaaactacatgcaattatatatctgacaagaagttctatcaaaatgtataaataatccatacaactcaatagcaaatatcaaatgacctcataaaaagagcaaaaacctgaatagatttttttcagaagacacatgcatgaaaaacagagcataaaaatgtcctcaagatgactaattgtcagaggaattcgaatcaaaagcacaatgacatatcacctcacaccacttaaaatggctattatcagcaagacaaaagataagaaatgttggcaagaatgatccacagccataaagagagctttgattggccaagagactgatttcagtaactttctcctgtgaagagaccactgaccatggacttgtcctggccaatttccagaggctgtgcactgtgtgtctttctgcccctgcacaaagcccttttgatatgcaggacccaactgtaattcatttagttcttaagtcctcaccccaaagcaaagctgaaatgcatgtatcatgtgtgtttgcttattagacatgagagcctccactccatgtgaatatccatagctccttctatagcctgctgagtgtgtacactcgaccaatccatttgcacaaatttgtttctcatctttccctctcttaaagtgcctgctcacagtctctgtgggaggctttccttcccagcctgttaagatggccatcctgcagcttcaaccctttctgagaaataaagtctcctttctaaatttataaactgggtgattcttccgttgaaagcacaagctgttgggaagagttatatggcaattccataaatgcctggaagacaagtgtggatagggtagggtaagaagtcctgggggctgcacaccccactctgatggaatttccctccagaaacttctgggttctcaagatgagaatccaaacagattccctcatggctctgtcatcaggagaactatactctgataagtatgcccagaacttcctccagacagaccctatagggaaaaaatacttttcaagatctttattctgtgaggggaagggattcttttccatcccagacagcttcatcttagccttcctgagtcatgaaaaggagtataattaataaaacatctggggtcagattcaagaaaataatctgtggatgctgcagccaggagggggagtggaggacggaggaaaatcagctgtaccactgaatactccttgtaaatggtacagcctagagaaagaatagcaagaaatcattggaattcaatttccagaacatatactgctcccctacccaccacatcacctcaccaccaatatgattaatctggattaaagagaaaagtgtggaaaggcacagactccatctaaggactagaatttagggaaaccaaaggcagtgggagagaaaaagtcaaggacagtaaagtgacttaaaacctcttagaccaacagcttcaggaacaaggtcacatcctctccctcactgaaattagatttacctctcatggggcatctgcagggtgcgcaggtgagaactggcaaagagaacatgaaggcactttccaaatctccattagtacctagctcgctttagctgtttggaaaaagcaaaaccacaacaaacataaccaggactaggatcagtgttggaagcacttttcactggcaagacactaagaaggagggcaaattcgaggccagttactatgcaaatatgccactgtgagtgtgtgtggtggtgagctttgagacatagggtctgtgggtaaagttataatcgataaaatcttcaaccacagaatcctaaaaaaaagagccttccccaaagtcccatcagttcctggactcgccatgtgtctggaccgtatcagtggatccggagctccagggaaggggctccctgatggcttttatgattccttgcttgccgtgctgaggtctccctgtagattatgttgggttttctaaggcctattttctattgtaagaggtggtgggggaaacaatttctgtcactgaaagagcattctgagccagggcacagccccttcctactgagcttgagattctgggaggaaaaagttctctgacaggaggaaaaagttcccagacaggaacttccctgcagggcaggagctgagcggcagggggcgctcagggagcacccagcacaggacccagccctggggcaggtgcacaggaggctggggcagggttttctctcaggaattgaatgttccttatttcaaagcaataatgacctaacatttaaataagaatttagcaagtactgatgtgcctgtaagtattttattgtatacgcagcctatacctaacccaataatttaatgcaaaccggatttaaaaggagaaatgtctaggtctttcaaatgtatttctagttaggaattgaggggtggttttattaattcaatgggtgttactgtccggagacacactcatcccagaagttagatgtgcagagggcaaggctcaggaaaagttcaggtagacagtgagccatatgaacagggaatcacattgaggaccatgtcctgtgagattctgggtttctgtgagaggagttctgtcttcatggacttctgggcatgtcagaggacaaatattaaacaaagttcagggcagggagctcagcatcccactgtggcgtggtccacatgtcacctatcttcttcctcagggtggcgtggcctgagctatgaaaaacctgcctcatgaatatgcaaatgcactgctgtctaccgaggtaaatacagatctttccttgcccagagaccatcacacaacagccacatccctcccctacagaagcccccagagcgcagcacctcaccatggactgcacctggaggatcctcttcttggtggcagcagctacaggcaagagaatcctgagttccagggctgatgaggggactgggtccagttaagtggtgtctcatccactcctctgtcctctccacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagacacagtgtgaaaacccacatcctgagagcgtcagaaaccctgaggaatgaggcagctgtgctgaggctgaggagatgacaggatttatgaagtttaaatctgtttagaaaatgggttgagtaattgagtaaaacagcaatggaaagatgtgtacactgtcattatgtaggaaatagtattttcaactgtcaccctataagtaacactcacagagtgggaaaggcagccatcaatcaagctgatgcaaacattcccatgggggctttgtggggacatacattttataattggatctataaatcattagaaacaggattgcttgatctcatggtaagactaaatataatttccaagaagtggccgaaatttcttccaaaatgtctttgcccttccttttacattgaatttattttaaaggagttttaggatcacaacaagtttgagtagaagaaacagagttcccatgcactcctgccccccgacgctcagccttctctgctatcaacaccctgcaccagtgtcataaatcggttacagaggatgaatctccacagacacattggttgtttccttttctggtggtccctggtataacaagcctcaactatcttgaagcaccccaggttcaagtggattcttcaagtgggttactgggaatgatgccaggtagaaggaaagtgggtgggaccattcctctttgcactctttcctcaaggatccataaaatgtacatttacatggagctcctctttctcctggttttatatgcctcttccccaatggtaaggtttcccagtgtttacagcgggggtccccagtccccgtgctgtggatccgttaaggtgtgcagtgcgttaggaactgggccacacagctggagatgagtgggggcgagccagcatcgctgcctgagctctgtctcctgtcggatcagctgtgcattagattctcctacgagccgaattcactttttttatatatatactttaattctagggtacatgtgcataacgtacaggtttgttacataggtatacatgtgctatgttggtttgctgcattcatcgaattctattgtgacctgcacatacaaggggcctagactgagcgctccctatgagaatctaatgcctgacgattgcagggggaacaagttcatcccaaaaccacccaccgccatcatccatggaaaaattctcttctaccaaactgttccctggtgccaaaatggttggggacactggtgtagaggcaggtctgtaccttggaaagccagcagcttctggtgaatcccataattaatgtcctttaatgagaagtggagactttggtcatgagggccttcgtgaataatgccctacagttggattcaaaacattgtaagctcttggggggtgtttctggataaagccctttgtgcagaaaatgcagacacatccatgggatccatgcaggaaaaaagcttcctttacaaagtggtttggcacctggaaggagctctcagggttgggcactgtaccctttgctggctgcactttagccagaggcttaagcctgattggtcttgcagtgggagagccttcctggggtcaaaggttacaaaaatgcctgtcatcttccagctgagcaagcccatctgcgtgcttgtcagtgtcaaccccatgaagggtgcactctggaagatgacaagatgcacacaaacctcctcccactgattatccactaccacacactcagctgcaacccgtgctccagaaacggacaggggcctgcaaggataaacagaatggaagtattttattacctgggaaagcactgccaaatgccacgtttcaggaaggttaactcataagtgttcaggaagtgactgaagggcagtggtgggtgaggtgacgggactgcctcagggctgcacatgaggagggctccctcccacacagccttttcctccaggagctgcaccaggaactcacagaggatcaggaaggattctgagaacattcttctgtggcgctgactagaggggcaaaataaattataaaaaataaatcaattctaaatataatatgatgtttgttattagaaactatttctggatcctgtgggaaccctgacataagccaccattctctgtgaacaaacatttaacctctccttccatggggaggtcgacgagcttggattggttctttcatggatagtatcccccaaactcctctccactccctgcgtatccccgggtctctcagtgacaagttctcctcagtggaatttggttgatgtagtgagatcttcaaatttcctgtcgtctgtgttctcatgttctccccttatctgagattaagaaacgcacctgcatgtagtaaattatagcctactgtctctcatggacaaaataatggccacgccaaccaaccttgtggctgacagcaaccactggcggccaccatcccctccacagcctgtgttggaacatcacctgagagattgtgttagcaactttccttcagaatcatcttaaaaactttgtgtcccatttcacatggagacgtcatttttccatttcatcttcatagagaaatagaaggagaagaataccaaatacacttcctatctccagattattcaaatataattgtccctttatcaccttctgatttctggtcttcacagaatactctacaaatttttctcactggcgttataccaaaagttgtgaagcaccagatactgggattaatttaaccaacattattattctaataattcttagaatttagaattacaattatcatcttttcgtatacggataaactaacctatgcctttgaaaataagcccttacatgagagtgaaaagctatagatttggaggatttccttgcaaatccaatatttggaaaacggattttatcacaaatatacaaattaacttacaattgaacaacaaaaccacagaatttaattttaaaatgggcagagacctgaatagaaaccatatccaaaaaacaaacataaaaagtgatcaacttgattttcattaggtgtacttatgtttaatatttaaaaagttctactaaactatgagaatgggtaaaaattacaaggtagacaatatcagatggtgatgaggaagttgaaaaacaggaactttcaccccttgctggtgggaatgccgaaatggcacatagaaaactacagttaataatttattgtatatttcagaatagctacaagataagatttggaatgttcataacactaagaaataatcagtgatatagatgaaggatatcctagttatccagatttgatcactgcacataaaatgcttttatcaaaatatcagttgtaccacctaaatattttgaaatattgtgtatctatataaatcaaacattaaaaaacaccaatgcagtggaatccagctaattgcagattcccattagatgggatgtgctgcatgatctgtaaactaatcagaatctgtgggtttgtaaaggactttagaaatcaactaggctgcttgtttctaaagataagtctccctagtttaaatattttcttaatgggtggcgattttgaacatagaagaaatagtaatatttgtgtcttgtaagttttcttcttctcgtgtcacgagaaaaggtttgcagggaggaatctgggaccatctttcaagtctcaacttcactgtgattacctcagtaagtattttctgatacccctgactaagataagtctcgtatctgtcctagaaactaaaagtagaattctaagcatctacctgaccagatggacccttcctcttcaccaaggagttccagagacacttttaaacctagctccggccgtgttagaaatagaggatcagaaatgcctcattataccctcctccctttggaattcaagcacaactaaccagcatttttatgaaaacagagcttaaggctcagaaaacagattatttgtagcagtaagataccaaattctaaccttattcgagaatatcatcacaggacagagagcaggcattgaaaggaatcaaaggcttttaccctaaaatatattcctttgacatattttaaaatagccaggcacagttatcttttgtgagagagatttacattctgtagagaatctccttccctttccaggtctttttcttataccgaggagattagctgagggtctagcttcttttaaaggtcttaggagaaaacatttcccagctattgcctctaaaggtggtcacataagagacttcatctacatagtaagaatcttgttctccaaaacctgttatcttaacctagaaacatttttctaccggtttcaggtctttagaaaaaagcttaaatctttcaatcaattgtcaatcagaaaatattcgaactcactgtaagttgtaatccccgccacacactgcctcacttctagctgttttgtctttatggaccaaatcaacatatatctcacatgtattgtttggtgactgtctctctagtacactaaatttaagctgccatcaagccactttgggcacatgttctcaagatcttctggggctgttcacagttcatggtcctcacattcgcctcagaataaatctctctaaatattttgcaaggttgctttttcatcagtagttctaacagaacctactctgtggtttttgttaaaagcattatattaatatagtattagtaatattagtattagttataacacatgttggaaaattcttatgaagttatgcatagactaacaatgggatcaagtgtaaatgtttcaaagtatttaagcaagttatttcaaaatttatcttctgcagatacttctatcagattcattatatcagctaattacttgctttatgatttttgcattttattgtagatgatcacaccctatattttcttggcctttattgtagaaaattgtgtgaaactagtcagggctacatttgcaagtaattgtcgcagtggctgcctgaattgcagtgggtttcctctgcagccaccagtcactcagattactccaatgacaccttaattttgtttcctgcttggctttgggccttagtcttgtgctctccagacagactctgtctttcatctcccctaggtcaggccagagccacatggacctgatgattgtcaatatggtgggaagggtcgcactgaacgggcactctctgtccttctgagggagccatactgcaggcagacatggcagtcctggctcagggtgtgtccttccaagtatccctgcccttccttcaggtgtgatgctgatccatgcatcttcctcccattcctgggtagagggtctccttgttctttccccaatcttctcccagcagccactatgtcttcccactgatgtcttcagcttcctcttttctgcccttcccagcagatgagtctgttattcctgagggaagagagaggaggtgggagatgaggctgttattcctgaaagaatggacagagctttggagcttttctttcttctaccccagtttctacgagttcctccagtgcctgtaacacagagctgtcagtggctttgcccctgcatgttaattctttggtcatgtagtggtggtgagggagctgggtctggatgcatttcagccacagctgctgttccacttccccacacagaaccgtctcaggaggaagaggttggagatttttctgatgtgtcctcaatcctgggagaaaagttttcaatagcaataggaatctctcagttgtatgtccgctgagaatttaaacaataacttctttataatactaaattttaaacaatccaatgaatatatctaatttaattttgtattagcttatgtgacatttgctggcctctcccccagataaggtcatattctcttcctgtttgttcctgcaagtcactgaatttcacaagatgtaaggtctcttgattatactataacatcaataatctggtgtactaaagaaaatgtgctaatttgcagcttactaaaattagttgttttagtaaaaataatatatttgttatagcatgcctacatctccaggctgagtagaagctttgtttgtaatactcagaaactgcaaataacacacatattaaggagctttctaaataaatactatgggtgaattctttaactggaatactgttcctcattagaatcaacacattctttatacacaaccaaattactgactcacaagtaattatactgagcaagaagccacacaaatgaaattgaaaatataagatttcactttaacaaaatcttgaaaaatagatctgaattaacaaagatgagaggttgactcagtatggtgagagggaaataatggggaggcaggaatgagaggaacacagggaggcttttaactgtaatcatcgttatctcgattgttattttggatacacaggtgagcacacgtgaaattacgttttttttccttcggagacatggttttgctttgtcgtccaggctggagctccgtggtgagatcatagctctctgcagcctcagaccctgggtctccagcaatcctcctccctctgccctatgtagctgggactacaggtgtgcaccaccatgctcggcttcagtgcgtattaaaccgcacacttcaattatgcagtatttattatatagcaataatgcctcaataagggtattacaaataagtggatagataatttgttaaagattgatggaaagatagataccaacatgagaaatgtatgacactcaagaaaataaaactgtaggaaacttgcttttctttatatttgttaggtaatcaccacagtgtgtacacatcacaccatgttcccattacagagaaaaggttctgcgaacctcacgagctgtgacccctgtgtgctgggcttggttcagggagaagtcaggtccagtggtgagaagcacaggcccagatgcccaggctcactctgaccaaatgtgagcactggggacattgtaaaacccacctgtgcttttgctgataatttttcatctttaacatggaaataatattgatactatataccatggtttctctgcgtatgtaaaaataaaagatgattggtgctaactttaaaaatatgcagtttatgtagatctatggtacctcaataaaactgttttaaaataaaaattacaaaattataagattttcaggttttaaggtttaagtttatcacaaaacaaactgacaataggaaagcacaatttcccaatgctttcaatatcacagatctccccgaggacattctgacatgctctgagccccactatctccaaaggcctctcaccccagagcttactatatagtaggagatatgcaaatagagccctccgtctgctgatgaaaaccagcccagccctgaccctgcagctctgagagaggagcccagccctgggattttcaggtgttttcatttggtgatcaggactgaacagagagaactcaccatggagtttgggctgagctggctttttcttgtggctattttaaaaggtaattcatggagaaatagaaaaattgagtgtgaatggataagagtgagagaaacagtggatacgtgtggcagtttctgaccagggtttctttttgtttgcaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacacagtgaggggaagtcattgtgagcccagacacaaacctccctgcaggaacgatgggggggaaatcagcggcagggggcgctcaggacccgctgatcagagtcatccgcagaggcaggtgcagatggaggctgtttcctgtcagggtgtgggacttcatcttcttctgacagtttctctagtgaacctctctaacctcagaattctgtgcttactaatgtcatctctacgtattttttaaaagatcattttaatatgagcacctattctcacacgcaccaaatgcagattgacgcttacagagatgaaaagttctcaaccatggtcaccaggatgagagtcctgaggaaattcaggggtgcctggtgactcttccgcaatcagtcctgggacagaaacctcagggacagcctttatgagttttgatcacatctaacagagaggatgggccagggccagagtcatgtagaacctcacaggttccacgtctgacccttctcctgacactaaagccaatcagcatcagcactgacctggtgctccttttgctcccaatccatgttctttctttggagagtttcttctcccttttttatttgcttttcctctttcctgaaaaagaaacagatggtccccttggtccacattccagggctcaaggcattttcttggagctcaggtggggctcaggctgtggctcctgcagccacgtgggagaggctgatgggacttccttctctccccattttctcaggaccctctactgtgttgtgtgtaggctcatctgggaatgcagttgaccattaatactgaaggggacaaactcatttgatcaaaatgggatgtggatgtggagttaaccctgttccgtgcacagtgtcagagtcgtctgcttcagaagtagtgttagaaagagctggtgaaatttatcagaatcaagatggagccacttgtgttaaagccctaatgaatgaagctggggaaggccatgaaggagggttctaacacacatattcctgataataagaactaccataaatagactctgcacaaccataaccttgcacagaagccaccacaacattaaaagaattacttctcccattgtatctgcccagcaactccctgttcaactttacaccgatgtgcccctgttattgatccttctagcccaggacaattgtcttaaacagctgatgtgaccctcctcatttttcctttattctttatcttcctataccaacctgaatgcacccatacatttcaattgcaatacacttcctagaatacatattattatattttagagtctctctctctctgttattcagggttgacaagctacagatggacatgccactttctttttttatgactttttttaaaaattttattattcttgtactttaagttttagggtacctgtgaacaatgcaggtttgttacatatgtatacatgtgccatgttgttgtgctccacccattaactcgtcatttagcattaggtatacctcctaatgctctccctccccactacccccaccccacaacagtccctggagtgtgatgttcctcttcctgtgtccatgtgttctcattgttcaattcccacctatgagtgaggaaaaaaatgatgagttcatgtcctttgtagggacacggaagaaactggaaaccatccttctatcattctcagcaaactatcgcaaggacaaaagacatgccacttttctgtgagatgtggaggatgacagtttttggagatgtctgggaatacccagtgtccagaagatcatccatcaataagtgcaggctggaggtcccagagagaggcaaagctgctgaaacaccatggaatttcattttctccagttctgctctgatggaatcaggcccacctgttttgcttgtcttaagtaaattcacagcaccacatatattagtgttgcagtgaataactacaaagtctatcctaaccaagtgtaccatcaaatttaccattacccagagggaagaatctttaacatgagatctatgttcataattttttaaggtgaaaaagtgatcactatccaatcaggcaaatatgattttgctaatgagtggtagatgttgcatgtatttttggatgtcatccctttttcagatgcatggcttgcaattatattttcccattctgtaggttggaattatttccacactttgtagaatctttttgttgtgatgtagttccacctgtttaattctgcttttgttgtctgtgcctttaatgtgaaatataggaaatcattgttaatatattattttctgggtcggggaaattttacaattgcaggccatatgtttaaatatctggcccattcagagtgatttttgtgtttattctaacccaaaattcttaactctttgcatgtgtacatccagtttttctaacacattcatagggagagacttggtttatctgttttatattgtgggttcttatgctgaaaatcagtttgccattgatacatcagtttatttctgagctctttctacatatttatgccaactccatcctgtttttattattctacttttgttattacttttgaaatctggaagtaagatgtaagtttatttttgcctttttacagatgctatagcaaaatattttaacctttcactcttccatataaaagtatggctttaaataatgacttttattatatacaggttatattcttgtattcctaacttttagaggttttattatgagatcttgaattttttaaatgttattttctatgtctggtgagaagttaactgatgcttttcctttattctcttaatttaccacatcagatttattgatttgaagatattgattcatcagcgcatctcaaaaataatttggagcttgtcatggtgtacaatccttttaaagtcttatagaacttagttgactatgaattgggagtagcttgtttatatatactaagaacatttgtcagaagctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttggcgcgggccgcctggccgtcgacatttaggtgacactatagaaggatccgcggaattctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttccctttctgtactgattgtcaggatcctgaggcctccccagccatgcttcctgtatagcctgaagaaccatgaaacaattaaaaatctttataaattacacagtctcaggtgtttctttatagtttgcgaatggactaatacagaatccaaataggaaaagaagaactcaatgtatctctccaaactgatgatataattctatacctagaaaattctaaagaccctgccaaaataattctagaatagataaacaattttggtaaagtgttgggatacaaaatcaatgtacaaaaatcactagcatttctataccccaactatgtccaagctgagactgaaatcaagaacacaatcctatcccacttacaatattcacacacacaaaatatgaaatgcctggaaatacaggtaacaaacaaggtgaaggatctctgcaaggagaactacaaaatacagcagaaataaataaataaatcgtacatgacacatgactcatctgacaaagggctaatatccagaatctacaatgaacttaaacaaatttacaagaaaaacaaacaaccccatcaaaaagcgggcaaaggatatgaatagacacttctcaaaagaagacatttatggagccaacagacacatgaaaaaatgctcatcatcactggccatcagaggaatgcaaatcaaaaccacaatgagataccatctcacaccagctagaatggcgatcattaaaaagtcagggaacaacaggcgctggaggggatgtggagaaataggaacacttttacactgctggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccagcccaaatgtccaccagtgatagactggattaagaaaatgtggcacatatacaccatggaatactatgcagccataaaaaaggatgagttcatgtcctttgtagggacatggatgaaaatggaaaccatcattctgtgcaaactatcacaaggacagaaaaccaaacactgcatgttctcattcataggtgggaactgaacagtgagaacatttggactcaaggtggggaacatcacacaccggggcccgtcatggggtcgtgggagtggggagggatagcattaggagatatacctaatgtaatgttaatgggtgcagcacaccaacatagcacatgtatacatatgtagcaaacctgcacattgtgcacatggaccctagaacttaaagtattatttaaaaagaaagaaaaaaactattaatttttctgaaccatgaacatggaatatttcagatatattttcaatttgtgtgtgttcactttattttttattatcaatcatttctggttttcttttagaaatctttcacttatttggtaatatgaaatataatttttagctattataaacaaaatgctttattgattttttgctgtttgcatttagcaatgccaccaatttttgtatgtaggtgttgtattctgcaaatttacagaattttttatcaattataacagtttttccagcaccatttattaaatagggaatcgtttccccatttcttgtttttgtcaggtttgtcaaagatcagatggtcgtagatatgcagcattatttctgagggctctgttctgttccattggtctatatctctgttttggtaccagtaccatgctgttttggttactgtagccttgtagcatagcttgaagtcaggtagcgtgatgcctccatctttgttgttttggcttaggattgagttggcaatgcaggctcttttttgttccatatgaactttaaagtagttttttccaattctgtgaagaaagtcattgatggggatggcatcgaatctataaattaccttgggcagtatggccattttcacgatattgattcttgctacccatgagcatggaatgttcttccatttctttgtgtcctcttttatttcattgagcagtggtttgtagttctccttgaagaggtccttcacatcccttgtaagttggattcctaggtgttttattctctttgaagcaattgtgaatgggagttcactcatgatttggctctctgtttgtctgttattggtgtataagaatgctagtgatttttgcacactgattttgtaccctgagacttcactgatgttgcctattagcttagggagatttggggctgagacaatggggttttctagatatacaatcatgtcatctgcaaacagggacaatttgacttcctcttttcctaatcgaataccctttatttccttctcctgcctgattgccctggccagaatatgtagaaagctgaaactggatcccttccttgcaccttatacaaaaattaattcaagatggattaaagacttaaatgttagatctaaaaccataaaaaccctagaagaaaacctaagcaataccattcaggacataggcatgggcaaggacttcatgtctaaaacagcaaaagcaatggcaacaaaagccaaaattgacaaatgggatctaattaagctaaagagcttctgcacagcaaaagaaactatcatcagagtgaacaggcaaccaacagaatgggagaaaacttttgcgatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttgggatggcgatcattaaaaagtcagggaacaacaggcgctggagaggatatggagaaataggaacacttttacactgttggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccaacccaaatgtccaccagtgatagactggattaagaaaatgtggcacatatacaccatggaatactatgcagccataaaaaaggatgagttcatgtcctttgtggggacatggatgaaaatggaaaccatcattctgtgcaaactatcacaaggacagaaaaccaaacactgcatgttctcattcataggtgggaactgaacaatgagaacatttggtctcaaggtggggaacatcacacaccggggcccgtcatggggtcgtgggagtggggagggatagcattaggagatatacctaatggtaaatgacaagttaataggtgcagcacaccaacgtggcacacgtatacatatgtaactaacctgcacattgtgcacatgtaccctaaaacttaaagtataataaaaaaaagaaaaaagagacccaattgttgacaaagttatgaaaaagatagtttttaaggagtctttaagtaatattgtattttctgcaaacagacaatttgatttcccctattccaaatttcaggacatttcttcttttttcttgtcaaattgttctggctagaattacagtaccatgtagaagtggtggaaaagagcatttttgtcttgttcaacatcttagagaaaaggctttcagtttttccagccttggtataatgcaagctgtgggtttcacatatctggactttattattttgagatatgtttcttgtataccaagtttgttgagaatttctataaggaatggaggttgaatttttttctatgactttcttaaagcaattaatcataaaataataataagcaggtcaatacaagatccataaattagtggaagctagttatttgcactgctgccatagagtaggatcactacacaactcatggtgttgatgggaaactataattctgcaataattaaagactagtgatttacactgggctctattgagagatttggttgtcaactacagaaatcgagatgaaggggcactgagaaacatttcgcttcatatcatctcaacttctaatatcaatttttagtactaatacagtcctattttctcagtatactgtctcacaggttatagtatatgtcttagaaaattaagggttgtttcattctaataattaactcagaaaaattcatttcctattatggatgacaagtgtaaattcatatcttaataattacccacactccaaaacactactacaggcaaaggcaagagaaaggcaggtatagatgagattctctgaggtcagttatgtaaatacccaaggactattgtctatgaccttgaatgtcactttcttcccttccatgagctacatccaggatattctgtgaatctgagagcgttgagcatgtttaattattttatctcactgccccttagtcttgctttctccagttgacaaccaaatctctcaacaataggcccagcgtaaatcaccagacttcaattattgtagaactatggtttcccaacaacattatgagttacaaaatgatactactttatggcagcagtgaaaatgatgaacttccactaacttatgaatctctgaatggctagcatggaggtgtgtatgtatcagcgcactgttctagaaatgttccgtttctgtccattattttatgtagtaatgaggacaacgtgaactaaagggagtatccatggccttataagcacagagaccacatccagtgcaggtgcagagcaaggctgcaacagtcagcaagttgctctctgaagagtcttccaattcccttgcccaaagcatctgctcattcatgggctgagaaaagggaagtcatgcatgcagtctactctctctacagagctgacaggggacacggacaacatcgattattcatggaattttcccataggaatgcagctgtgtgcacacacacataatacatttttaaatgttttttttatttatcctctccaattttaaaaaagtcatcaccttttctcctaatcaaagaggattttgaccagaatgcttggtgggagccccctgctctcccagatgcccacccttatttctcttgaagtgaagaacggcagctctcttgatttctactctcatcctctaggactaaaaccagaaggttccacgccccctgggtgaacatccaagaagaccctgtctgtagcagcaggagcctcaagccttgactgagagctatggtcctgaaatgagacagtgtcccccatggagagcacacgtggacgcccacaactgagggctcactgctcttcaccacagatgcgctcccttactgagtcctgagacctgagtgcaccccatagggtagggctcagaagaggggatgcaaatctccaccagctccacccttctctgtgttgaaaagccgagcatggggacctagttcagtgactcctgtgccccaccacatggagctttactccacgcttctcctgctgactgtcccttcctgtgagttcagtggtcagggaatccttcaggggtgaaacacctgttcttttctttgtgggcttcatcttcttatgctttctccacaggggtcttatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaaggagaccacagagacagagcccagggtgcctcttgtacaagaacccaggctgcttctcagtggcgctccctccccacctctgcagaacaggaaagtgtggctgagatgccatttcctgtcagggtctgggtgtcttatcctatctgactcagagccttgtcttcctccctcttctttagtaataaatggcatgacccctgttagtggttcatgcaagcagaggctgtatcctgtttgacaaagattcagcatgaaaggttcctgttacttgagccagatgcatcactgatatgtggccaccagtttcttagactcataccactttaagggaccaaatacaaatgtccatagcatatgccattcttaaactgcagaaatgatgtcaaagaagaatgtggagataagagagcaggaggaattatgaaaatctggatagcatcttctcttctagggtggaaggtatgctagtaaagtaatttaatgaaacaatcagacagatgcaatatgtcctcatcatggagtgtctcacatgggcagtgcacaaataaatttctaaaaattccataaggtagatgtgatggatgaggcttatttccacacagggagcccacaaatatccagagaagtaaaaaatctgacacttggaaagaaaattgcctcatcttgacatcagaaacccatttcaacatgtccgaggggcaatgtggaaaagaaatggaaacttcaaaaacacatttcttatgaaatgtctagctcatgtttgaacataaaaacagaattgtccatgattttagaaaaaccaacccatgacagcgagtcactacactcagaaacaccactgagtcaacagacttcagtctgtgagcaggtcagtactgaggccccaggtgaatcaaggctctcacgtacattgtacagaacccagaattgagccacacaatctataaccaagtcttctttgacaaactttacaaaaattaacaaaaaaatacaccagagaaattcaatatatgaaattcaatatacccattcaatatatggtgctggggaaattggttagccacgtgcagaagaacaaaactagacccccaccctcaacacatatatactcaacacaaaatgaattaaagacttacatataagacctcaaactataaatctactcaaacaaaacaccaggacaactcttctgggctttggcctaggtaaagaatttatgactaagaccccaaaagcaaatccaagaaaaaaatagacaaatgggacttaattaacctaaagcatttttcacagcaccggagtgaacagacaagttgcagagcgaaagaaaatttttccacaccacacctgtgacagggaactaatatgaagaatttgcaaggaactcaaactactctacaacaacaacagcaacaagaaccaaataactccgttaaaattagcagaggacatgagtagacattttcaaaagaacacataaaaatggataataaatatataaactacgctcaacatcactcatcatcagggaaatgcaaattaaaaccacaataagatatcatcttccaccagtcacaatgactattactaaaaactcaaaaatatcagatgttggtgaagatggaaaggaaagggaactcttagacactgttgatgaggatgtggatgaggacaacttctatggaaaatggtatggagatttcccaaaaaactagaaatagaactcccctttgatccagcaatcccactactgggtttactacccaaaggaaaataattttttatttccaaaagatatccacacttctatgtttatcacaaaactattatcaacagcacatatgtcaacctgagtgtccaccaacagatgattttataaaagaatatagcatatatgcacaattcaatactagtcagccacaataaggaatgaaactgtcttttgcagcaatatgcatagaactggaagacaacataattagtgacctaactcacaaacagagagtcacatgtcacatgttattatttataagtggaaggtaacaacgtgtccacaaggatatggagagagaaatgatggacaccagagacttagaaggatgggaggtggaaggtgggagcatgaggagacattacctagtgggtacaatgtacattatttgggtgatagtacactaaaagccaagaccactatggaatatagccatgtccaaaagtggcattcgtagtccttaagtttatacaagtaaatgtacacacaaataaaattaaaaatataaaataattaacagttgaccaatgatcttaaaagttgatttaaaatataatcaataaatgaaatgaatatcagttgaacctcattaaatttgaaaacgttttatactcaaatgactataagaaaatgaatgtcaagtttcagatgagaaactgtttgcaaatcattagccaccaacataagtataataagaaccctcagaactcaactgtgaaaaaaagaaacaacccatggatagaataggcaaaggtttgtgcagacatttcatcaaataagatgtacagatgacacataggcatataaatgggctcgcaacaggattttccattcgaaaaattcaaatcaagccgacagtgagacactactatacaatttttagaaattaagaagaaatacagataataccaatgctggtgagcatatcagggtccaagactctaaaacgttgcaaacaggaatgcaaaatgaaactgctactcaggaaaataatttatagttttttctaaaatcaaacattttcttaatatatgacctaaatatcccactcctgaatatttgtgtcagagaaatacaatcttagattcacaacaaacttccatttaaatgttcaatatattgtgctcacgtgtgtgtgtgcacgatagaaacaaaaagtaacatgaatgtctcaaaatttgaataggtaaaaagtaggaagtgtctattaattgaataccatcagcaataaaaaataacaaaatgactgatacacaaaccattacaggtgaactccagacatgatgctaagtgagagaagccagtctcaatgatcaaagggacacatctgtaagcaccacggtcatcctcaggtgtcagtggtttgggctgggctctctgtctctttcctgaccagacccagatgttgagctccgccacttgcagatggaaaattctactattttcaacaatgcactgaggtttgaactgcttcacagactgaacgaaacaaacacgggctcctttgaacagtgtgcagcatttgttccaaccacaagagaatgtctcccagctctgccccttctcagttttccctgcaagccagcagccctgcagtttagcctgcatctcccatgcatgcacccatctccttccaagggccttactccacaacctccacttattttgagtgcactgactggctttgaacttttccacattctgttgttattgaagttaggatgtttagagccatattaaggatcatattttatgactgaattccagtgccccctctctcctgggacagagcacgtaaccaacattctgcatgtggagacaaagatgagcttttttcttcctcagcctaggagatgagcgctcagtggagggttggatagaagcttcccaccttctcagcactccagttctggtggggagaacctctgccataggagcagagctagaaaccagggaccgaatgttcccagtgacactggacccagggtagagcctccatccacgagtggggctccatggaagaagcgagtctctggctctcagtagcttttgtccagaactgagccttaggatcgtgtactgtgggcagagtcagagggccaatgtcctggctcctggggaacagtttcctctgaagggagctgggtagaaggtgtcctgtcttcttggctacatctgtttgcagtggagtttacatcatgctgagttgggatgtggaaggaaggaggagcatcttagatcaattatgatggctagacttactgaattttgtagattttcttgaataaatgtttcttcacttgctgtatgctgtgagagcctttccaaaccctgtattttttcaaaataattttcactggtctcatgagggcatggattcattgagcccctcatgctatcaaagagaaatagaactttttttgttcactttttagagaacatccatgggttataaaacaatgggttgacttctcttccaaaactttacagataccgtcaattttcctcttgcttgtaaggttttatccagaagaatgctgtcatcattttttctgcttttttggaaggaatgccccttctactcacctcaaattgcctgcatgtatttctatttttctttggttttcagcagttttaataagatttagctaaatgtgtgtggggggagcagggagtgtcattctgctgttctgtgttctctgagatgcatggattcacggtttactctgtctccattttggggaacacaattagaaaaaatgtcagtgtgagcccagaaacaagcctccctgaagtgggcagaggaccacctgggggcgctcaggacccactgagcacaagagccagccccagggcaggtgcagacgggggttaagatctggtttcccgtcagccctgtggcttcctctccataaaacagttccctcgggggcacgtctctggattccttatcttgttcttactgtgaagtctctgaagaataaacatttgttgtaacaagagaaaaattttctcccatgcaccaaaggcagagtcacctacagtcaattagtcctgtttctcaatgttaataaactatcaatgtttctgaaggtacattgtacagaacccagaattcagccacacaatgtatagccaagtgatattgacaaacttaacaaaatatacaccagggaaaggacgtcccattcaataaatggtacttgggaaaatggatagaaacatgcagaagaacaaaactagatccccaccctcaacacattagtcaggtctctaaaatgcaggagtacatatctaaaatttattattttattgtgcatttttacgtgttccagaaggtgggagaaatttctttctgtgaagagcatcccaaagtcaggcactcctctagaacacgtgtttaatccttgtctttggcttattgatgagctctgttggctgcaataacttctgccatccgggctgactttgcatcatgtagaggagcaaattctgaatgaaagtttgcactactcaattgagtgcataacctacagttttgttactgatgtatgattcatcagagatgatatcagatcaaggatttcaatgagaatctaatctaaaagatgtaaacaaattttcctaatttagataaaattactgtgagcacactgctagtattcagccatgtctcctatcacattgaatctacactaagtttgacctaaaagctagcacttgttctcatgttccaatatgttatttttattttaatgtattcagattactatgtgttgctattttacccaaagtgaaggaaagcaattttaactgactgaaaatgagaaaaagcacaacctaatgaaatggaagtcaggacatgagtgtctccagccttgtctatttcaaaaattcacgtacgcagggggatttctttcctcaattttacacagagaaacttccaaaatgtttgtttcctctcccatggactctatcatcagtttctatgtcagtttgcttagaattttggcctccagctccaaccaatttggtgcaaaaacatgatttcattcttttttatagctgcagagtattgcactgtgtataagtaccatgttttctttatgcagtctataactgatgggcgtctaggttgattccctgtattaggtaatgtgaattgcacagagataaacacatgagtggatgtgtctttgtgttacaatgattggttttctcttgggcatatacccagtaatgagattgctgaggggaatagtagctctgttttaagttctttgagaaatctctagactgactgaattgttttctctgtgaatggtgataattatgtcaatatttgtcaaattttgaatgtattgtttgaagattgttatttgtcaatattacctcattaaaactattaaaaatggaagtgtataatttggtagaaaaggattaaaagaaagataaaaataatacaagaaaagtcacagactcctgaatccacatgtgaattagcactcagtttttctatattatttataaaaacactaagatacagccaaataatatcatgatatccttataagaagagtgtttcgtaaacctcactgggaatttctagctctgtcctagagttaatttagggagcagtcggatccagtcctgagcaacacaggccagacactgagacttaccacatcttaccagatgtgagctcttagacacgtcacatggcctctccatgcttgggggtttaccttcacatctgtaaatgaaggaaacattgactgccacagaacatacttcatgtgcatctatacagtagaaatgctaataagaattaattgtttatgaagtgtaatcactctgggacacagcccactcagaggcatcccttccagaacccgctatatagtaggagacatgcaaatagggccctccctctgctgatgaaaaccagcccagccctgaccctgcagctctgggagaggagccccagccctgagattcccaggtgtttccattcagtgatcagcactgaacacagaggactcaccatggagttgggactgagctggattttccttttggctattttaaaaggtgattcatggagaaatagagagattgagtgtgagtggacatgagtggatttgtgtggcagtttctgaccttggtgtctctgtgtttgcaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacacagtgaggggaagtcagcgagagcccagacaaaaacctcctgcaggaagacaggaggggcctgggctgcagagggcactcaagacacactgaaaacacggttaacactgggacaagttgctcaggaaggttaagggctggtttcctttcagagtctttgctgtttctgtatctaacagtttccccaggaaccctgtctagatttgcgatcttgatctgcttaaactgtctctgtgtcatttttcttacctgtgactttaggggagctgatcgtggacactccagtgtgtggagatttcctggtgacagcaattgtgtgttctgtctaagcatgtctagggccggtcatcaggaaggacaggaaggacaggctggaattcttggaaacagctgcacctgccatccaccagggaactttattgtcttctgttctgctaaaattaaatcaggcacaccaagtttaactagcactatcttcctagcttaagaaaattgatggcaggtttcaataacacctatattaaaccttcagagcaacacctacattagtgtctgatttgataattgagactatgttctagccaagcagacacataaaactggtgattgccatgcttagttcatatttcatatttatcaatagaatctggctggtgttataaacagatttgccaacacatgtgtgttagtgtttgtcttcggagaggcacattctatgactggattaagtttgtgtacaggttcctaaggaacctgttcatgcttttgagaggaaatgcagagggggtggaaggcggctggggaagctgaaggtatacgagggaagtcagtccctgagtgaaggagagagggaggagaactgggtagaactttcctaaacttctgtgctggtctaggaaggtccagcaagatcactgagtcagattcgtgtcaaagtttcccatcggggacccccgtgactcccagcagtggctctgctcagatcagcacagagctcgttcttctcctgagagtggagcagaggatgtggctccagcaccagccatggcatggacgtcagagagcagccccaggcacctgagtcgggtgcattgtgccccctgcaggtggacggagggaggtgctgactcagggcccacacgctgtgggttctatacagaacacacacttttacttcatttctgtggatgacatagaaacaaacatgcagtctattaacagcggtgattcctacatttgccccaattgctttattccttgattccgcagaatatcctgacgcagaattgtctttctctcgtggaattgcgacgtgtttaggacgtgtgttccccactttcagtgttctgctccatgaacagagatcctgagtagagtacagctgaccctccttccacactgttcctctcctccccacaggaagagcagataattacctgaggctgaatctgaggtgggatctgtcctctgaacctcagagcctgcagagacccccggctgcagattcatggagtcaggtgtttgtacatgtgggaaacttgagctgttcttttgtcagtgaacactccttagaactaattgtgggttcagaattaggacacccattgatctatcacacctcagctcattctgccactcagaatctccagaaattcaggaaatggttcaatttacatgtttgtgacacattgttctcatttcatttagttgtgagtttggtcagcaaaagtgctaccatttatgtgtcccaacctgatgaagctaacttgcttcaccagatgttgggagctcctgaattttatcctaagcccctctctctccacttcatgtgaaattcggtttgacctggaattctggtgtgttgatttagccagatttccccatactgagtgtctgattttcctggatatctgatcagtttccttgtccttcaccataacttgggtgacatctgatcaccctgggctaacttcaacaaaaatcctggcaggttgccttaagcaggatttacctcactcctgatgtttcttcttgattttccatcctttgccccaaccctgctgcatgcctataaatccccacgttctcactctgtatttggagttctgctgaatctctccctcattgcaaaatcccactgccctggtccctacacctatcatgagggccctggataaagtcttccttactgtgctgtagaaagtgtctttgtatatacattttttctttaacaaatctgcctttagtatttcctaattgatcaaggaacctcaaacattgaatgaaagtgaggttttccattttactaacatatgtgtatctgtgaatttcaatttcaatgtgtggtgtccagaagtcctgagcaccaacagttgtgcttctctgtccaattatttgattctgaaacctgggagtcatcccaacacaggtaaatatgtgattttttttttttttttggtttttactgtttagtgactgacttatttcacttacactgaagcttcatgaacacaatgatgaaaagtagagagaggacttgtttgaaaatgccagatttatggtagactttaccacccacgtgtgtctggaggtcttcttaaggttccaagaacaggacatttttcccacaacaagacaaggatgagaacctctgagctgtgaggatggaggacaggcagggccatgtgtggacaaggacgggctgctgctatgtccagggtgttctctactagcaaccactccatctccttcctcactctgtggtatttgtcagatgggaaacatgcctagaatttatctttgacatctggatggaagcccaggcaagaggcatttgacagcttattcgtgagcctacttctttaaggaatgccagatcccttgctctccttcctagttcttaacccctttaactcccttcccctcctgcacccatccactgcctatttacagccacgtccccacacccttcactgtagcaccattttcttgggctcctgggaaacacaacagctttggtttaactcacagctcaggcacactcacgggtcctttcagaggctctcaacttccctcctacagtccctcagctcctcctggggtcctaacttggccatctctatcctctctgctgagcctggccatacacaatccatcccatctggatatgtgtatagcagtgggttaactcagcaggcatgaatagttcaaaccctccacgttcctaaaaaggtaaataactaaaaaataaaaacaaaagtaaacctttgttcatttatggctgtctgttacctcctgggatgagatctccgagtccatgaaatcttacacctgataaaagtgtctgcagatgtctgcagccttgggacatgctgtacgagtttaatcacagtgatttatagtgaacgcctgcttttgttttgctggggagggctgtggtctgagtattgtggtcagttacccaggtgttccatagtctatgattcattccccaaacacagccctggacaagaaaactcaggggcactcccctgggtgttgacacttcacacatgtcatcttacctcatagctggagcattacacatgtgcagaaggctccacagtgggaggacccctgagagcttgtgcctggattctcctgagcttcactctttgtgccttttttttccatgtattttcaattgtatcattttgctgtaataaactgttcctgtgaatacgagttttcatgagtcctgtgtttttactgagttttgagcctgagggtggcagatgcaacttctcaatgcagttgtatcagaagaaggatttcctagagagatcctaagtgacacatggctgaagtattgttcagaaaacataagtattcaggtgtggaatggcaaaatctgatacttgggtggcaacagaattacccggtctgagacagcagctgaactgaagtagatgtctggagataaatgcaatttagaaacgataactcatactcccaaagagctggctcaatcgatacataaggaaaaataaaatgataaaaaataacctaaatatgcaattactatttgtgagaacatccgggagagtgattgcagggaaagtggcctgcgccgacctcagattttggccaatgtcatttctggctgatgggctccagggcactacctaagggagcaattatgctgcaatgacagacagaagcttcgcaagctctctccacccagaaggtggttcaggtggtgaagtgcggggactggtgagccacaaaacactgaaatgagggaggaaagtgagaaagtgaaaggcttttgagctttttctttagcttaataatttttgttaattattaacaaaataattggacaatgactaatgtaaaagtggaccgtgttttgagtcccttagaacggaggagaatgcagcggtcaatgttgtgcccagagattactatagaacaatagtaggtggttgaacatgctccaaacacaaagcctcttgttgctgatgggacagctgccctcgtctactgcacaacagcttctccaaagtgtgtttaccctgagcattgagattgcctttctcttgtaagtgaaaaaatcggaaaactccaaataaaggaggagttgtaacgctctatgtgtaagaaattctaatgtggatttatgataactgggatatgcatccacttatctttttatctgtaaaaattcatgggtgaaagtgcaattttgttacatggatatattgttcagtgatgaagtctgggctttgaggagagtcatcatctggatggtgtatattgtacccagcaagtaatttctcatcccacacaccactcccaccatccaaaccttccaagtttccaatatttattatgccacactctatattcatgtgtgcacattatttagttcttacttatatatgacatgtggtattcaactttattcttctgagttatttaacttaagatagcagcctacagtttcatccatgatactgtaaaatacataatttcattttttattattgagtagtaattaaatgtgtgtatatatattcacaaatatatataatgtatttgtgagggtgtgtatgtgtgtatatatgtgcatatatacatatacaacatgttttctttatccaatcattcattaaaaacacttagtttggtaccgcatatgtgctattgtgaataaggcaacagcaaacataaatgcagcatctatcgaatataaaattcatttttctttgagtcgataccaagtagtggatttgccgaattaaatattagttccatttaataagagaacttaccaacatctgtttcttgtttagtttagtttttatttttgactttttaataatagttattctgactggtttaatatggcttctcgttttgacttcaaattgcatttctgtgatgattaatgacattgattgttttttcatatcctggttgatgatttttatggcctcttttgaaaaataaatgtctgatatttgctcactttttaatgtggctatttgtgctttttgtgttgctttagtttcttgtagattccaaatattagctctttgtcagatgtagtgtttaaaaatatttttcgtcattctgtaggttttctgttaactttgttgattatttattttgctgatcagatgttttgcttcttatttgtattaagtccaaataacctattttggtttagttgtgtttacttttaaggtcatagtcatgaattctttgcctagcacaatgttcagaaaaacacttcctaggatttcatttatgactttcagactctcaggcctcccagtcaagtcttttatccatattggtgtaatgtttgtatgtagtgagacatatgggtccagttttattcttctgcaaatagctgttcagtttttcctgcacaatttattgaacaaggtgacattttcccagggtatgctttttgtctggttggtcacagtcagttggctgcaggcacatgactgtatttctggaatgtctattctgttccaagtatctatggttctctggttgattgttacttgtgtataaaaatcctactggcttttgtatgcttttttatcctttattctaaaacttcactgaattaattcatcaattctaggagtacttctaaagaatattagtttttaagtacaaaatcatattgtcagcaaacacacacaaaaaactgacttcttcttttccaatttgggtgcctttatttctttctggtgtcttatttctctggctaggatttcaagttctatattgattaagagtggtgaaagtgggcatccttgacgtgttctgagtcttaggaggaatactttcaacatattgctactcagtataatgttgtatgtgagtttgtcatatatgatttttattaatttgaggtatgttttccttctattctaattttgttgagggttttttatcataaagaaatcctaaatgttatcaaatttttttttctggacctattgacatgattatatgttttttgtttatgtggtggatcacagttattgagacatgaacgttgaactatccttgcatccctgaaatgaaacttagcagattgtagcatattatctttttgatatgtagttggacttgattttcttgtgtcttgttgaggatttttccatctatagtcatcagtgatattgatctgtagtattcatttttgggtccttgcatggatgtggtatcaggctattagtggctttgtagaatgagttagggagaaaaaccctctcctcgtttttttggaaaaagtttcagtagaattactagcagatctttttgtatattggacagaattcaccttttaaaataatatgctttacggctttgatgttgagatttttttaaattactgcttcgatgtcactaatttttgttggtcctttcaggatttttatttcttcctatttcaatcttgggagattatatatttccagacatttatctattcaccctaaattttctagtttatgagcctggagatgttcatagtagactatgttgatcattatatttctatggcatcagttgtaatcttttcttttttgtttctcattctgcttatttaaattgtctgtctactttacttgcctaatctagctagtggtctgtaagttttgtttatcatctcaaaaacccaatgttttattgtattggttctttgtatttcttggttcttaactttatctagttctgctctggtctttgttatttgttttcttctgctgtgtgtttggtttgatgttgtttttctagttatttgatacgtaatgttaggttgttaatttgtgatctttctttttgatgtggtcatttaacattataatcttatcccttagcacagcttttgctgtaaaccagaggttttggtatgctgtttctctatttttattcatttcacaacatgttacaatctttttaaattttatcattgacccaaagttcattcagttgcaggttgttaaattttcattgtgtgtgtagtcttgaatattcttctagggtttgatttctggctttatattactgtggtctgagaagatatttcatttttaaaaagttattgagtcttttatttctggcatagtatataatccatgtttgaaaatattccttgctaatgggaataatgtatattctgcagtcattaggttaaatgttctgttaatgtctgttaggttcatttggtctagagtccaatttaagtctagtgtttctttgttgattttctgtcttaatgttttgcctagtattatcatttgggcattgaaatccatcacaattgtattgttacctgtgttcttccttaggtctaatagtatttgttttatgaacatgggttttctggtgcagagtgcatatatatttagaattgtcatttttaatcaatcattttatcattatataatgactttctttgtctttacttactggtgtttatttaaagtttttttatatgatatagatagtcttgcttgcttttggtttccaattgcatgaaatatattttttcaccctcttgatcttgaatctacgtatttttaccaattaagtgagtttcctgtcagcagcataaatttcaaaactcttttttattctttccactaatctatatattttaggtgaagaatttaactcatttatattcaaacttaatacagatatgtgaggtctggcttctgttgtcatgttaattattaactagtggctttgtagtcttaattgtgtaatagttttatgagtgaattttataattttgtgttgtttatgatggtgagtactgacctattgcttccatgtctaggtctcccttgagcatttcttgtaggtgcggtctggtgtaaataaatgtccttggcattttcttaccttagaaatactttatttctccttcatttatgaagcttagtttagaaggatacaaaattaatttctgacatagaattttttctttttttttctttaagtagtctgaaattgggagtccaatctcttctatcttataactttatgctgagaagtacactgtcagcatgatagaatttcagataaattattagacacttttctattgtgaattttaggatttttttcttcctatttactttagatagtctgaggactatagatcttggtaatgtctgtcttccagtgtcttctcatgtagttttctgaaccacttttatctgcatatgcaaatatctagcaagactagtgatgttttcctcaattacttcatcaaattggtcctctaaaactttttactaattttctccctcaggaatatccatgattattggctaagttgttttacataatcctatacttcccaatgattttgttcatttttttgttattttcatctgactgggttaatgcgaaatatctgtctcttaggtttgatgttctttcttctttttagtgtagcccattgtgaaagttttaaactattttttgtaattaaaattcaatgaagtctttactccctgaagctttatttttaaaatattaaagtcttaagtaaatcttgaattgttctgatttttttttttttttttttgacacggagtctcatactgtcacccaggctggagtgcagtggcgcgatcttggctcactgcaacctctgcctcccgggttcatgcaattctccttccttagcgtcccgagtagctgggactacaggcacacaccatcacacccagctaattttttgtatattgagtagagacagggtttcactatgttggccagactggtctccaactcctgacctcgtgatctccgctccttggcctcccgaagtgctgggattacaggcataagccaccacgcccggcctgagttattctgatttatttgtgttggttctcaaatttcttttggatttaattgagattccttgaggtcaacattttgaattatttatctgacatttcaaatatatcatgttgtgtaaattctatttctggagagttaaggtgatatccggcgtcttgtaattgtgttttttcatacttccacaattgcttacctgcttgcttttcattggctaaactatctcttactgtttttgaattcattttgattttcatgaaaatttcattccctttagaatgtgaatataacgtatattatgtgggtcttttgatttggttcttggtttactcattggcaaaggctctgtaagagtttcttgtatatagatagtcattatttagtggctttctgaaactatggttgtagtaataatctactgggcctgtgagcaggctcactgcctcctgcaggccctaaatagtggaggcctcagaaaccatttcttatttgcaatgcacttgtttcagcacattttatattgggatgttaagttcacctacacattagtatgtgtccttacagatttgagctgactgtggtagaagcagatgagtacatgcttgatatctgtacacagggagaagctctctgttgcctcaggcgatggactggtctatgaagtgcacagtgacttgagttctctgatcagcccctgagtgggggatgaagctggacagagatgagccaccgagcctggcaagcaaaagcgccagccttgatggaaatggcgagctgaggggcatctactcagtgtggtttcttttgttattaagagctttagtgtggtggctttttcaaattcccgttgtagtagtaacatactgagcatgtgagcaggcccgcggtcttttgcggggttggaatcacagaagtattgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttaccggtggttaaagtgggaaatttgtcatgttccagatcttagagaaaagacttttagctatttctcattcattataatgctgcctgaaagtctctcgaacataactttttattatgtcgagatgtgttctttctatacccattttttacattttttttcctgaaaggatgttgagtttcatcaaatgatttttcagcatcaattgaaaaaaactatatgtcgattaaagatctaaatgtaaaatctaaaactataaaaactctggataataacctaggaaatacaatttaggacattagaactggcaaagacattatgaagaaaatgcaattttaacaaaatcaaaaaatggcaaatgagccctaagtaaactaaagagcttctgcatagcaaaagatactatcaacagagcaaacaggcaacctaaagaatggaaaataaaatatttgcaatctatacatctgacagggtctaatatttatagcatacatgcaattaaacaaacatacaagaaaaaaagtgcccaaaggacatgaaaagacacttataaaaagacctacatgtggccaacaagcataggaaaaaatgctgactatcactatcattagagaaatacatattaaaaccacaatgaggtaccatctcacatcagtcagaatggctaatcttaaaaaaataataacagatgctgctaaggttgcaggaaaaagggaacatttatacacttctagtgcaagtataaattagttcaaccattgtggaaagcagtgccatgatccctccaataacctaaaacagaagtttcatttgacccaacaatcctacaactggacatatacctaaaggagtataaacgtataggttcattccagcactattcacaatagcatagacatggaatttacctaaatgcctgtcactggcataatggatagagaaaaatgtgatacatataaccatggaatactatgcagctaagaaaagaatgaaatcatgttctttgtaggaatatgatggaactggtagtcattactcttagaaaactaattcaggaacagaaaaccagatactatatgttctcacttattttttggagataaataatgagaaatattctctcagggcctgagtcttccatattcaaaaaaaaattctaaaataagtgttcaacaagttgccgacatgcctttaaatatcctgtttcatctggaccccttatatcactcaataaagccatgagaactatatttaaaagtgggattctatgataataaataacttaacagtaagaataggaaggatatggatggttttactaatttaatgggtacataactgtggtatacactatattcctatgaataagatattctgatttcagagctaagtattgtttcctacgttgtgtgtgtgacttggttgtgttggatttgagagtgtagcacgtgcacagaccatgtggatcagaaatccacatgtaaagatgacaatctatggatgtgaactacaagtatgtaagtacttcaagtaattctatttaatggagtttgaaataaaactcaaacttattcaaaacactaattacttggtatttattttgagatctatgagtttatcaagaaattcaaattcctatttctatttaaactcccgattcctactctcagtgggagggaaaactcacagccaatcacacatcacaggacaaatctgtaaacgaagagtcattcctctgaaggtcctgggtgttcaggactctcaggcaggtgctgaggaccctgtcttgggagtgcccagcagatctcagaaccctacatggggcctgctggacactcatgtgggataactagtcgccacttattcagagttaccagtgagctttgactgttccgaatgggaccagcatggagtcaaggtgcctgctcaatgtcagagacagcgatggtctcagaaacaatccaggtaatctctaggccaataaaatgtggattcacagtgagaagtacatcctggaggtggagcttgttcttcagtgggaagagtgctgtgcacagaaagcttagaaatggggaagggggtgcgtttcctcaggcaggattagggcttcgtccctcagcgtcccactcttgtatggctgatgtggcatctgtgttttctttctcatactagataaggctttgagctgtgaaataccctgcctcatgaatatgcaaataacctgagctcttctgaggtaaatataggtatattggtgccctgagagcatcactcaacaaccacatctgtcctctagagaaaaccctgtgagcacagctcctcaccatggactggacctggaggatcctcttcttggtggcagcagctacaagtaaggggcttcctagtctcaaagctgaggaacggatcctggttcagtcaaagaggattttattctctcctgtgttctctccacaggtgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggcacagtgtgaaaaaccacatcctcagagagtcagaaaccctaggggagaaggcagctgtgctgggctgaggagatgacaggggttatcaggtttaaggcttttttgaaaatgggttatatatttgagaaaaaaataacaatagaaacaagtacacactctaattttaagagatatattcaattcaagaattgtagaagccgaattcacagtgggaaaggccacactcaataaagttgataaaaacattccaggaaggtgctactgtgaacaagttttcaaattagatgaataaataatttggagcaatgttatttgatcatgaggtgagacagtatgattcttaaaaagtggaaaaaattctttcaaatgtttctgccactctttatcataaaattaattttagagcagttttaggattacaatgaaattgcacagaaggcatgagaattcccatgactccctgccctacacaggcagagcctcctccactatgaccatccagcaccacagtcacaaatcagttacaatggaggaatctccaaggacatttgattctttcttttttggtgatgccctaatataacaagcctaatttatctcggaataccacaagttttgttcagtggatttctaggaatcatattagttagagggaaagttggtgaggctcttactatttgaactcattcttccaaaatccacaaaacatatattaatttaaagcttatcttacttctggtttacaggatccttcccagagagtaagatttttaagattttagaggcaggttcatgtctctaaaaggccagcaagttctggggaatcccataatgaacatcctttcatgggaattggagaccctggcaatgagagactccatgtataatgccctagagttggattagatgcactgtgagctcttgggtggtggttctgaaaaaggtggtctgtgcagtaaatgcaaacacatgcacgggacacaggaaggagcaaaagcttccctttacaaagtgtgtgggcacctggaagaaaccctcacaagggcacgtctcacccttaatgactgcacattagccaggggcatgatcatgattggtcttacaaggaaagagcaccactgaggtcataggttatgaaaatgtcatcctccagctgagaaattccatctgctggcatgtgcgtgtcaaccccgtggagggtgcactctgggagttgacgagatgcatagaaacctcctgtcatgaattatcgtctaccacacagtcagaatcaacctgtgctccagaaagagatacatgcctgtagaaataaacagagcttaaggattttcttacctgctgaatatagtgcccaaaaccacactttcaggaagattagctcagaaatgtttacaaagtgactgaagggcagtggcgggtgaggtgatgggacagcctcagggctgcacttgaggagggctccctctcccatgcaggcttttcctccaggagctgcatcaggaactcacagaggataagggagaattctgagaacatgctactgtggtactgcctagagaggaaggataaatgatgacaaatacatctctgagtaacatatgggcatttgttcatgaaaactgttttttctgaaagcttatgaaggtcttgaaatgcccctgattagctgaggacaaacatttaaaccctccttccacagggagttcaagcaggctggatgtgtcctgctatggatgatcttccccagccccttcctcttcccagctcatccctggctctctgtgtaaaaagttttcatcagtggaaggtggttgatgaagtgaggtcttcaatttcctcatcttctctgtggtcatgttattttcctcatctgaggtttaaaaactcacctgcatgcagcacatgacaggctaaaatctcttgtggacaaaacagtaacaaaggcacccaccatggttgagcacccgtgttgctgacagtgaccaccaagggtcaacgtcctcttcacaatcctgtgtcagagcagcacttgagtgatttcactagcaacttcccaggagaatcggcttaaaactacttgtcgcattttccatacagatataacacatctattttcctgaagaaatagaaagagctgaatgctgaatacactgtatgtctgctggttctgcaagtttgtgactatcactttctaatttctgatctgtgtggaccaccctccagatttttctcactggtgtgaccagccttctggatgtcaaatataattaactttttttcatataaaagtcaacacaagctcctcatggtttcggtgctcactgactactttaaacttacacaatatgtttctttattagttttgttttctggtatctctactcagcatcttcaacacacccatgttaagatgcttgtacaggtaattgttaattttaaatttactggtgtttagtttaattaaataggcaggcaatagcttagaatttagaaacaacaatgtaaaggaaaagtaaatgcaataaaatttaacataagaaaaccagcagctgaaaggaagggaaatctattctgccacctaagagggtatggtgacctcatagtacaacgaacttctgcagtttaatcgatactgctcacaagtgatagcattctctctctttatatcagagcattccctaacatgtacaataaagagtgagcagatacctccaaccagactgaccagtacctctccctgagtgcctcagctgatagagatagacatcacatttgtctaacaaaataattacaggctgtaaggatacccaccagtcatatggagataatttgaaaaacttagtcaaagcccaaaccttataggtagtcatttatacttagaagaattaactcttatcttcacatgtatttttcttaatcatagagaagctactagagtcactgtccaagttactgaatatcttattcctagaatgagacattgcacaatgtgttctgacatgagggaatgtagctatagttaaaggataggagatgtgatcacggaaacacgagtctgcgatccagcagttctttctccctcacatttgcccagaaacaaagaccccagcagaaaaatggaagggttgacttcagtctccaaagtatgatgtgagatatacgtcaggtatttcatgccattgttttatagtaggaaatttaatctctaaagaaggtcattttcaggataatactattctccaggatacttaaatgcccgaaaacagagagcgctacagtgcccagtgtccaggagctacctggcacgggtctggaaaccagtggacagaaatatcagtttctcttaccacatgtatgttggaaatttgaagaatgtttctttccttcttcgtaatcataggctgcaatggactggaggtcccagtacataagaggaaatgtgtctccagtaggaacacaattagtcccataaaataattgtgctcacactgtggtgcccacactgttggaccagctgactgagaaagtgttgtaagagctgcagtgtctactgattcctatcatatttggggctacattcgcagctaccaacggaaagagagagaagtaaaactggcttaggtagagtctatggatttgctttctttccttcaaactgaagtaaaaaaaaaaatcacatcaactaaaatggggacgatgatgaagtgatcaaggacaagagccactcagtgttttaggtgggttttaacctaaagtcccacaacatgtgagaacctgaactctggagtccggggcatctctggggagaatgtggaaggtgggcgggaggaaacagtgattcatgtctagggaaatttcagggctacctgctctgggggaaaggaaagcctgagcctctccgacagtgtcctctgttaaaattgttggctgacttattgtattcttcaacaccaatatttttttagtcctcttttaattttgtttttattattatactttaagttctagggtacatgtgcacaatgtgcaggttagttacatatgtatacatgtgccatgttggtgtgccgcacccattaactcgtcatttaacattaggtatatctcctaatgctatccctcccccctccccccacaccacaacagaccccagtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtctatcattgttggacgtttggcttggttccaagtctttgctattgtgaatagtgacacaataaacatacatgtgcatgtgcctttatagcagcatgatttataatcctttgggtatatacccagtaatgggatggctgggtcaaatggtatttctagttctagatccctgaggaatcgccacactgtcttccacaatggttgaactaatttacagtcccaccaacagtgtaaaagtgttcctatttctccacatcctctccagcacctgttgtttcctgactttttaatgatcgccactgtaactggtgtgaggtggtatctcattgtggttttgatttgcatttctctgatggccagtgatgatgagcattttttcatgtgtctgttggctgcataaatgtcttcttttgagacgtgtctgttcatatccttcacccactttttgatggggttgtttgttttgttcttgtaaatttgtttgagttcattgtagattctggatattagccctttgtcagatgagtagattgcaaaaattttctcccattctgttggttgcctggtcactctgacgatagtttcttttgctgtgcaaaagctctttcgtttaattagatcccatttgtcaattctggcttttgttgccattgcttttgctgttttagacatgaagtccttgctcatgcctatgtcctgaatggtattgcctaggttttcttctagggtttttatggttttaggtctaacatttaagtctttaatccatcttgaattaattttcgtataaggtgtaaggaagagatccagtttcagctttcctcatatggctagccagtttttccagcaccatttattaaatagggaatcgtttccccatttcttgtttttgtcaggtttgtcaaagatcacatgcttgtagatatgcggcattatttctgagggctctgttctgttccattggtctatatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagtagtttttcccaattctgtgaagaaagtcattggtagcttgatggggatgtcattgaatctataaattaccttgggcagtatggccattttcacaatgttgattcttcctacccatgagcatggaatgttcttccatttgtttgtatcatcttttatttcattgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgattttttcacattgattttgtatcccgagactttgctgaagttgcttatcagcttaaggagattttgggctgagacgatggggttttctagatacacaatcatgtcatctgcaaacagggacaatttgacttcctcttttcctagttgaataccctttatttccttctcctgcctgattgccctggccagaacttccaacactatgttgaataggagtggtgagagagggcatccctgtcttgtttcaattttcaaagggaattcttccagtttttgcccattcaatatgttattggctgtgggtttgtcatagatagctcttattattttgagatatgtcccatcaatacctaatttattgaagagtttttagtatgaagggttgctgaattttgtcaaaggccttttctgcatctatcgagataatcatatggtttttgtcgttggttctgtttatatgctggattatgtttattgatttgcatatgttgaaccagccttgcatcctagggatgaagcccacttgattatggtggataagctttttgatgtgctgctggatttggtttgccagtattctattgaggatttttgcatcgatgttcatcagggatattggtttaaaattctctttttttgttgtgtctctgccaggctttggtatcaggatgatgctggcctcataaaatgagttggggaggattccctctttttctattgattggaatagtttcagaaggaatgctaccagctcctccttgcacctctggtagaatttggctgtgaatccgtctggtcctggacttttttaggcaggaatttccttgtcctaataagcccaggagtgctacaggagaccagggcttatttcatccctcagcggcgaccgtaaaagacagccatcccgaaagcagccatttcagaggcctcccctcagggatgcattctctttctcagggatgttccttgctgagaaaaagaattcagtgatatttctcccatttgcttttgaaagaacagaaatatggctctgttccacctggctcaccagcagtcagagtttagggttatctcccttgttgcctgaacattgctgttattctgttcttttttcaaagtgcccagatttcatattgttcaaacctacatgctctacaaacaatttgtgcagttaacgcaatcatcacagggtcctgaggctacatacgtcctcctcagtttacaaagattatgggattaagagactaaagtaaagacaggcataggaaatcacaagggcattgattggggaagtgataagtgtccatgaaatcttcacaatttatgttcagagattgcagtaaagacaggcataagaaattataaaaggattaatttggggaactaataaatgtccatgaaatcttcacaatttatgttcttctgccatggcttcagccagtccctccgtttggggtccctgacttcccacaacagtttattaactttgtatgactaataatgtaaaatgttccccatatttttagcaatgttttacttatttgtgaaaggtgtgtttattaatttttcattttaaggtgtcacatttatctttcttgtttctgggatttcattctagtagatatagctgaatgcattttaacaattattgtaatcatctcacattttatatttggatttgcatatacattttattaagattttgattttgatataaaatattttcttacaattgtctcttttctatttttatgagataaaattaatgtatgcataattgcatacatcttcaatgtacagtttcagggtttctgacatatgtgcacacatttgtctccagcacctaagttaggatgaggagcaggtcagtctccacaacaagtgtcctcttcagtgcttccagtcagctctcacataaggatttttatttaatttcaagttttcattttcactaatcatcagagaaatgcaaatagaaaaacgttctggtttctgtcactacagttcaattttttcctgttttgggcatcacataaatggaatcaaatgttatagttcattttttgtaaggggctacttttgctatttgtgaggttcattcatgtatttgcatctaccaaggttttgtcatcatatatatacacacacacacttatatatgtactaatgcacatataggtatttcatatctcaatcagtccattacgttaataaatgacagtttattaagtaaatccattcattaagtgaataagtgacaaaaaatatatctattttcctgttgatggaatttagtttccaaaataaatatcgtaaacacatctgttataaatatctttgtacaagttcttctgcttatatctcccatttttattgataaaatatgtataaatataagtatgcattataacttttcagctttatggagctataactgacaaataaaattgtatgaatttaaggtacaccacttgaggtattgatatacatggggaaatattcatcgtgatcaaagtaattggcatgcctatcatctcagagaatatcattttatgcctttaatttattgtgagtctgtgatgaaaacacctaagatctactcttctggaaacagataagtttataatataatattcattagtatagttacattgctgtatgtttcatctccagaactccttcaacctgtgtatcagtccattctcaaactactttagagaactacctgagactgggaaatacatgaagagaagggagttagttcactcacagttctgcaggcttagcaggaacttatagggaggcatcaggaaaattacgatgattgtggaaagtgaaggggaagcaaggaccgtcttcacatgctggcaggggagagagagaaagagcaaggggagatgcgccacacttttaaacctcaagatcttgtgagaactctaacacaagaagagcaaaggggaaagccgcctccatgattcagtcactccccatcagacccctcctacaacacttgaggatgaaaatttgacatgagatttgggtggaaacgctgagccaaacagtatcattatacccggccactcacaaatctcatatccctctcacattgcaaaatataattatcccttctcaacagtctcccagtcttcactcaattcagcattaacacaaacttctacagtccaaagtctcctctgagacaaggtaagtttcttggatgtataaccctgtaaaataaaaaacaagttagttacttccaagctaatatgagatgaatgcactgggtaaatgttcccattctaaatgggagaaattggccactacaaatgggctacaggccccatggctagtccaaacactagcagggcagtcatcaaatcttaaagctccaaaaaaatttccttttactccatgtctcacatccaggacacgttgatataagaggtgatctcccaaggcctttggaagctccacccttgtggctctgcatgttagactccccatagctgctttcataggctggcattgagttgctatgtcttttccaggcacaccatacaagctgctggtggttctaccattctggggtctgaaggacagtggtcctcttctcacagatccactagacagtgcccaagtggggactctgtgtgtggaatccaacaccatattttccttctacactggcctagtagaggtactccattagagctcagcccctgcatgagacttctgcctggatatccaggcattatcatacatcatctgaaatctaggaggaggttcccaaacctcaactcttgcctcatgtgcaccagcaggctcaacaccacgtggaagcaaccaaagcttagggcttgcaccctctggagcaatggcctgagctggaccttgaccccttttagccatggctggcacaggacagacagggatgcaaggcgccatgtcccgaggctgcacagagcagtggcgtcctgggcttggacaaagaaaccatttttctctcctgggcttctggacctgtgatgggaggggctgccacaaagatctctgaaatgccctgcggacattttttcccaccggggtccttgttacttatgcaaatttctgcagccagtttgaatttctccccataaaatgaggttttttgtctaccacatggtcaggctacaatgttttatcaaacttttatgctccgcttcccttttaaacgtaagttccaatttcagaccatctctttatgaatgcacatggcttatgttttcagaaacagccaggtcaactcttcaatgctttggtgcttagaaatttcttctgccagatataccttaaattatgtctctgtagctcaacatttcacagatctctagggtagggggaaaatgccactagtctttttgctaaagcatagcaagtgtgaccttcactccagttcgcaataagttcttcaccttcatctgacaccacctcagactggacttcattgcccatatcactatcagcattttggtaaaacccattcaacgagcctctaggcagtttcaaacttttccacatcttcctgtcttcttgtgagcactccaagcttttccaacctctgcccattacccagttacaaagtcacttccacattttcaggtatcttaatagcagtatcccactcctggtgcaagttttctgtattagtccattttcacattgctataaagactacctcagactgggtaatttatgaagagaagagttttagttaactctcagctctgcccgctaaacgggaagcattattgggaggcatcaggacgaacaatgatggtggaaggtgaacgggaagcaagaaccttcttcacatggtggcaggagagagagagcaagtgagcggggaggtgccacacttttaaaccatcagatctcttgagaactttatcacgagaacagcgaagaggaagacaatcccatgaccaaatcactttatcttaggcccttccttcaacatgcagggtctacaatctggcatgagatttgagtcggaacacggagccaaaccatatcaaccttcataacgggaagtttttaccctttgaccaacaatacccaattttttcctcctcccagcccctgcgacctactattctactctgcttccaagagcttgaatattttatactttagattctatatataaatgagatcatgcagcttttgtctttctgtgtctggcttattccacttagcataatgttttctatttgttgcaaatataagaatttctttgtttttaaaggctgaataatactcagttttatgtaggtataagccacattttatctgttcattcgtagatggacattgactcgttttccttatctagactattatgaataatctcacaatggacatagatttgtcacactcagtttattttctctagatgtatgctcagaagtggggatgctctatgtccagttcactgagtaatcttcatgttgtttttcatactggctgtaataattcacattttgttccaaaccatacatggatacctttgtaccacatattcaggtctttgtgtaactcttgaatccatttttagctgatttctgtgtattgtgtgaggtgagttctatctatttcttctgcatatggatgcccgtttttcacaccactcgttgaagagactgtcctttctctactgtgtgtcttgggaacttgacaaagatcagtttattaggaagaaatgggttggtttccaggttgtgtttaatgttccattggattatatgtctgtttaaatgccagcattataccattttgatttatatagatttgattttgaaattatagattatgatatattcagctttgttatttatgcccaaaattactttggctatttgaagtcttttatatttttatataaattggagctttttaaaaacattttgtaaaatcatgccatggagattatttatttattttattggcatatagtagatatacctattttatgggaacatgtaatatattgatacatttataaatgtgtaaagattagtgtaagatttacatatctgtcacattaaaaatgtaccctttccttgtgctgagcacatttgaatgactcctttcgctattttaatgttgtgcattagattattattaactatagtgaccttactgatctatcaaacatttaggtcttatttctcctctataaatgtatatttgtatacagtaatcaacctctccttatctccttctctcttctatccatccaggattctggtaagcaacagtctattctatcttcaggcgatccagtattttagttttgatgtaaaataagaagatgcaatatttgtctctcttttattggcttatttatcttaacataatgacttccagttccattcatattatagcaaatgacagaatattgggtttcatggctgaataatatcctatcgcatacatagattacatttactctatccatttgtccacctacagacactgaggtgctttcacatctgggctattgtgaaagagctgcaaagaacatgggaggggacatgccttcatgaggtggtggtggttttatcttctttagaacatacccagaagaggatttgccaagtcataaggtatttctgtttttaatttattttggaatcttcatactactttgcacatagtggaaacacaaatggagtaaacattaaaaaagcagtttcggttttgatgtataatccagaaacaaataatgtttgaccatgattctcattaggagtctctaatggatctggtggaaatgcaggaagttttctaaccttgttcaggaaattatgagtttgcacctttttctttttgaggcttgaaattggcatgattcatgatgcatactgttgggaggtttcagaatgatatggcaaaaatcataatgaaaaggcaagacagagagagagggagagagagagagtcaggcctagaaagagaaaaaataattttctcaacaggagaaagtgctggatatctgtatcagtgttgagttttgctcatagacacatctgtaccgagtgaggaaccatgaagtcaagggaggggtctagaacttgttcaagtgaagcatcagcatatttctcacaggcaccaatttccaccacatcacaagggtgatgcatttttgaatgccattaaatatgagttcacagtcagtaatcatgtttccatgaaattcagttaaaataccaagggtgtgtccagatcactcatgcacaaatacacaaaatttgctttttcatgtgtggctatctagagacaaagtgcactgaggagacttcagcaggttacagagatttgcttaagtttggaaaaccatagaagagtgcctttaagtgaaggttggtatataaattaaataggtcaaaatcccctctatggagtagcgttccaattgtgtggaatttttaattccttattcagttgtaaaacataatccctaggactgactccgtggagttttactgctgtgttgacaaaaatatctaacaagcttccttccagtgtttcaagggaagtttttctctaaattttttccaatgtataaattttcctggctaaagatagtaaaaggctgttaaaaacacaactggaatggcagctttaatcttttgctgattgataggagtgagcataatacatgaatctctttgagtgttctgcctcatccaaatacaataggtcaaaggctagtactggaggtaagatttccaaatgtgtttttttccagctaccaagtcataggaaaataacagatacatccttgagacagaggaccataatgccacaatgctggtaggagtacatgtagacaagggagttcaagggtttcttaaaactgataattttaatgtaagaataccattcttttaaacttatgtggaagactgtgggaggttataacaatgccatattttagtatcagccctgcctcacagaatcattttataacagttcctttcatgagtgtgcttcactcggttcatgcaaaaacctggcagatcacaggctaaaaacagaaaatatagaagcttttaatcaactgaaagagctgtagcctttgtcaaggaattattggaagacacagagaacacagatagatgataaataaaatacattcatatcccgttaagtgtggaaattgaggaaagtttacataaatgtgtccaagtggcaaactgtttatttaatctggtaaccaatttttctataaattgtagagttgaaatgcaacaaatacatatttgaaatgatctggcacaaattaagcaaatatggtaactatgtattttcactcatttttatttaagatcagcggctcagcattgatatttttgataatatctgtgactcagcagctttaccttttgaggatatgatctggtatggcagttttcttagcttcaatgttacctctttttgcattgacttccacctttatatctgccaggaatctggggaaaaggagtgcctgtaaacgttccctaacttgcccattttggtgggttttccagaatgtgtgagatgctttttttttttttttcaaagcatcctgaacccatgcactgccctgaaacatgtttatttcctagtttaacaaattggcacttctaataaatgcaatctcttctgccatctgtgctgattttacatcagatagaggactgtgttctaaaggaaatcttatattagtaagagcaattttgtcattaacctagagttttattattgaggtgtgattcataacatataatattaggtagaggttctcagtggcagtgtctaaatctcttgggtgtacagtgtcttccccgttaacatgaagcatttacgagcacagtcatagtttccagccatgcttctccctgtctcacaatcaccacaaactaactatgaccacaactggaacttggtgagttattctttaataagttttaagtttgtctttaatctttatgcctctagattattatgtgagacataatctttatgcctctagattattgtgtaaagctatttcagaagaaagttaaaaagaacattttaactgactaaacaacacaggaaatcattaataaaatgcaaagtgtagatgtgagaggctccaggcctggataatgcaagagttcatgtatgcaggcagtttctttgcccaattatactgatacaaccagcatgtcagcttcatgccccatttgactcctattatgcaagcgcatggaaatgacatgctcaagggtcacacacagatatgaaaactggtgggagcaggagaggagacgactctgcacttctcctctgaaggaccaggaaagcctggacagaccatctccccagcctccatgactgcgcgacgtgcccacatggacactcatctctgacaagataagaagactccattgatgaggctgaacattttatgatttaaattactagagacttacattgaggtttcaataactaatttttataacccaaatttacttacccccatgttgttacctctttcttcagtgaaaaattgcttttgctgtaattgagttttaggaagattcccagtgttcacaactgagcttccaagagagtgttgagaacaaaaactgaatgagggcagagaaacccatctttactgtgttcaccactaaactcaagtggactcggcactgcctttgatcactgttgcttctctgcagagttcaggtttgtatttctcacaattctaacacagactctccctctcctcaaaggtttggcctccactggctgtaaggtcacactgttctgaatttcttgtctgaaccgttttatgagggtggtgatgagccatttaatggaaattttatatcatctcagcatgaatcctatgggcggtcacgaattattattctgattatggtaattgatttttctcagcatattcattactagtgatattcaaaaaccctttttatttaaatctttgatgcttcatttttgttgctatgacactttttcttctactgagtcttcccactagcattataacatgacctaatatccagggctcagttgttatataacaaccacatatgtcaaaagctatgcattcttttcacagcagacataattttctcttttctggagatgaacacacactggctgagctacccccactcacaagaacatatggaaaatcatgacatttttatttacttgactaataaattatgtcattctctcttcaaattctttatcccccagaatgccatgacaaactcttctgcatctgttcaaaccataaactcagaaaccacatggtgagtaaaagctcacttgattcgggatattgggtcaagctcttcccctccaatgtcccacagcattgggacctcagcccacctgtccaggttctatcaagagagtttagctccttcacagtgaaggaaacaattgagttaagagggaacctgcagaagatagacaatattgaaaaccattcatatgacaagggattactatcaagcatataaaataaactcaacccaactgcaaataataatgtggctaataatggaggaataacattaatacatatttctcaaaagaagaaaagaaaaagggcagatagatgatagatagataaatagatatattagtatgtatacatacatatatcgctagaaaacactaatattcaggaaaatgcacattcacaatgagatgtcttttcatcctttatctttgcttgagagtcagaaaatctaaataaataaataaataaaacaggagctggccaggattcatagaaagggaaactcttatagaccattggtggaaatggaaattagtgaagccatcatgggaaaaaatagaactaccatataattcacaatccaactgctgagtatgtatctatttaaatcattaaagtaaaaaactaatattgaagagatacatgtacacccatgtttattgcagcactatccaccatagctaacatatgaaatcaacatatgtgtccatcaacagatgaatggataaataaaatgtgttatatttacacaatggaatattgttcagtcttaaaaatgaaattctgctgttagaagcaacatggatggaactggacaccatcatgttgagtgaaacaagacagacacagaaaaataaatacagcattttctcagtgttatgtggaaattttaaaaagttgatcttctagaagtaaataatagagtagtggttatgagatgccgggaatgggaggagactgagagacaataagaggtttgttaacaaacgtataatttacaggcagataggagggatgtgctccagtgatctacagtgcagtagggtgactgctgttaacaatatagtgcacattttatgtttacaagtagccagaagacagaaatttgtatgttaccaacaaaaagaaatgttagtgtctaagctgatgaatttgttcattgttctgatttaatcataccacatggcacacatgcatagaaatatcacactgtaccccatacagttattatgtgctaactttaaaaaatcctttaattaaaacagattttatttgcatacattacaaatgcttcaacacagagccaggaataaataccatttttctttgaaatgtgaatttcctaacaacgtagttacattcatttgaaccaaaccgtgtatttgatcatggtaagaatagacaggcttatgcatagaatgatatattttaattttagacttctacttaataccataaattcaaataattttaaaacaactaagtaaaaactataaagttgaggaaatgtgtacgtggtgtgtgatgtgtgactttttccttgcgcaccactctgtccatggtggatgtgtggtgtgggtgtctgtgtctatttctgtttactctgcttgaggttctctgtgattctaggatctgtagttcagtgtctttcacaaaactgggaacgttcttagccattatttctttcaaatactgtctctgtatctacaatttctcctttcagatttaaaatgtacatatacaatactttttaatattaatgtttactttcttcactctcttttccttgcactttactctgtaaaatttctagtggtattttaagtgagtggtttcatttaaaaggtgagccagctctactgaagggtgtgcccaaagcttactcaatgtttatactgcattgcttttgatttcttatgcatttccatttgattttttcttagtattttcaactctcagttccctatctagtccttcattatgtatacagtttccttaatagatttttacatatgaattatagttactttatatatcttgtttaattagatagttctaagatccatatcatatagaagtctcattctgatcatttgtttattatgactttggtatttctcattaatatatgtaatctttgttgatagccagatattttaggttggacagttgatattggcttattacttcattttatgcattttctgcctgtatttgaccatactttatttttgccaggcctttaatgtggaaatgtttgaatcttctcagagctacatttgacgtttacttttgcagtagacgtcatagttgaagtctgttcttctgtgtccaccagagacttcagatcctccagtgataccttgtttttctttcctgcttggctttgtctcttcaccctgttccttcctccagagaatctctttcagctccttcaggtggattaagatattatattgaactgacaattgtgaaattggtggaaggcaatagaataaagggagattttctgacctttcatgggtctatatttctacgaaggcattgtgaccctgagtctgggtgtgacattgccggtgtttctgaacttctgccagatgagatgttggtctgtgtgttcttgctgttttccctgctgtggagtcctcttgttttccccagttgttccctcccacagctccaatgttctcttttggtgttatcagcttccagagttgatgacctgacctagagattaaggctctgattaaataagaaggaggggagatacttctcaatggaacttaggtgaagacctctttttccatctcagttcctaagggatggccccagtgcccctaagatcctggctttggtggcttgctcctgcagagtaatttcttagttctgcaatggggattaaggaggtgggtctgaatgcatttcagagtgtgggctctttttctctcccagacagacacattgggacaaaagatttttgtgactgtccccatttttgggaaaaaggtttcaaggtataggaaagctcttcagtatgtggtccctgagaaattcacgctacaacacatttaccacacttgacttcaccaattcagtatgtatgtatttttttctcttataatagcctacatttttatatgccagactctgcctcagttcaactcatacccatgcctttttactctctgcaagaacttgtctctccctaaatttcggatttgatgattatcttaaaacctccagtatttaaagtatattttaaaattggcaaaattccatctcctgtgtttatctgttatgttgatgctgtaaaacagtaagtaaaatatactcctcatctatgtacattttgaagctgagttgcaggttttttggtaagacccagagtcacagagaattcaaatattgttaagctgcttaatagaaaaacaaattatggtaaatgtgttcactggaatactacccatgatttataataaataaatgcctgacacacagaacagcagcaaaaccacacatgctcttattacagaaagtggcttctgaaaaccacaccgggcacgtacagctttgtcctggagttggtttagggggatgtcagagccagtgacgagaagcacagggccagatggcagcgttcactcatcccagacatgagctcctggatgcatacagagcccccccatgtgtgggtttacttccacttctgtaaaaggagaaaatactgactcctacagagcataatttacacattttttaaaaaatgtaatagggtgatcagggcaaagtgtttatcacagcacaatttcataagacagcatattttccaaataccatcattgtcagcaaacttctgcagagcaccgtcttcttatatgggtacagcctattcctccagcatcccactagagcttcttatatagtaggagacatgcaaatagggccctccctctactgatgaaaaccaacccaaccctgaccctgcaggtctcagagaggagccttagccctggactccaaggcctttccacttggtgatcagcactgagcacagaggactcaccatggaattggggctgagctgggttttccttgttgctattttagaaggtgattcatggaaaactaggaagattgagtgtgtgtggatatgagtgtgagaaacagtggatttgtgtggcagtttctgaccttggtgtctctttgtttgcaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcaggggtcccttgggaccaccagggggcgacagggcattgagcactgggctgtctccagggcaggtgcaggtgctgctgagggctggcttcctgtcgcggtctggggctgcctcgtcgtcaaatttccccaggaacttctccagatttacaattctgtactgacatttcatgtctctaaatgcaatactttttttgtcctttttgtttctttgtttttttgcaacaggagtacatatcctcagctccacagaagccagggtgtcactttgggggcagaaataatcgtttcgtggtcaacaggatgagagtcctgaggaatcccagggaaacctggagagtgttttccaattagactcagggcagagacctccatgggaatttctgattagaacgggctttgagctctgatgggagccaagagacaggctcacccagggtcggggtccttaaagcctgatggttttcacagctatcccccctcgtcttgtaaactcagactgattcagttgaccctttttctgctaatccattttgcttctctgtaggtttgattctcacagttcgctttcttcttctcttccctgagaacaaacgatgtgttttctgttttcagggaaaatcccagggctcaggtctgcaggacctgggtaggctgaggagactttctcactcaccattgtctggacactcctgttgtcttctgtgcatggaggcatttgggaaatgaagtggacattagtcattaagggaataatactagttttctccaattggatattgatgtagagctgaacttgtgcttctcacactgtcacagagtttggaccctcacctataactttgaggagagttgatgatggatagtccattgtgggtgagctctgggtaacagtaattgtagggtctggctaggcagcctaaggtcaatacttctggacctcaggaaagacaggctggaattcctgggaagacctgcatctgccatccaccgtggagtcccatcatcttctgttatgctgtgattgaatcagccccacctagtttatctagaacactcttcatgacttaggaaaacataatggcaagctctcctaacacctgtatcatgccatgggagcaacacctaagctagtgtgtgattgagtagatgagactgtgatctagtcaagacgacaggtaaaattgattgttgtcattatgatattttatatttggcaatataatcatgctcatattataaatacttttgctacattttttgagtgtgtcagaggctttggaactggaacaacttcatcttgaataggggctaggaaaaataagaccgagacctgctgggctggattcctagtaagttgatgcagtaagttagtcacaggatgagataggaggtctgcacaagatccaggtcataaaggccttgcagataaatcttacagtaaagaagctgggcaaagccctccaaaaccgagacagtggctaaaatgacctcagtttgtcctcactgttcattatactctaattataatgcattaacatgctaaaaaacactcccttccagcccccaagacagtttacagttgtcaaggcaacatcatgaagtttccttgtgtggtttaaaaaggaggggaggaacactcaacttcaggaattgcctggaggactcatgaataatccatccattgtttaacatataatcaagaaataaccataaaatggacaaccagcagcccatactgctgctccacctctggtgtagccagtctcattattttacttgcataagaaacttgttttcattttaatctgtggattttccccaaattgggacccctttctcctaatatttgtgctattattcgtgttctgagcagaaaaccccaagatggaatgaagtttccctacatttttataagaagtacattcacccctttgagcgaaaatgcacagggagtggaatgaggctgggaagctaatggcgtatgatggaagcttgtccctgactggaggagagagggagggaggattgggaggaaggttcctatatttttgtgctatgcaaggaagctgcaaaagataactgagtctcgtgtaagtcagtgctacctctcaggggatccctgtgactccaagaaagggctcttcttaggaatcactgtggagtcagtcctttcattagagtagaccacaggacatgggcctcagcacacgccatgccacagatgtcagaaagcagctgctgggaacctgatccacctgcattttgctgcctgtaggaggagggagggaggtgcattctcagggtcagcacactgtttgtgaatttttatagagaacccctgcttttgctgtatttttattggaaaatatatgaacaagtgtgcacctgcaaacaactgtaattttcacatttccttcagttgcattatttcttaatcctgaatgacgtcctgacacagagttgagtttttcacaggcattgttcgaaggatcgagatgatggcattttccacattcactggtttttctccatgtggcagagaccttgagtagagcacatctggcccttatccacactatctcttgtgtcccctgggaaagagcagagatttgcctgactgcagaatctggggtaggagtctgcacacctctgagcctgcagagaagctcagcgaagttttgtggagtcagagagctttccgtgtggggaacctctagcttcctcactctcggagattaatggtcagctgtacttgaggggttaagaattagagcaccttgggagcctgtctcatcacagttccattatgtaacttaccaccattagactgcgggtaataactcaatcttgatttttctgacccgattttttcatcttattcattactaattttgtttatggaaaatgttatgtttagtttatgattaaaacctcagaactttctgaacttatcaggaataatacaaatgtgtccagtttgggggaaatgtaaatgaatgtccatgcagtttgggtgtgtgtgtgtgcgtgtgtgtgtgcatgtgtgtttgtttgtgtgtgtgtggatatgtcagtcacttacaccacaatgaacatgattgctgaattacatagtcaaactaaaattagatttgctgaaaattgcctgcagcgatgtctgtgaagctgaccctgtcactttgctgtgaagaaactcagtgtacaggcgaggttgcacgggagagctaaaagcttctgcacacaggacaggctgagctcctgaactggagccaggcacaggactgagcacctgagaaacagaacccccagccctcctttatctgggctggatgggcaccagaggacccgcaggagatgctcagaactcacacaagacagagcctcagtgaggagcagaggcagcgaggaaccagtccagggagccctgtgaccgccacctcgggttgtcttattttgcttaacagcatccaaacctcaggagaccatttattacgttatttagacttccatgccctttctgtcccgaagtaaaacaaacataaatatgactctgcagttagctctttgaacctgggttatttttctgagaatgtcatcttcgtcatcaacatcatggtcatcatgtcaaaatcaacaggcaaatccagtcaccgtgaagacagtttcatggcatgattcatacacaatcattccattccacagagaatctctttcagattcttaaggtggattaaagtgttatatttaattgccaattgtgaaattggtggaagacattatactaaaggaattgtctctgacctctcatggggtcatatttccagaaaatcattgtgatcctgagtgtgagctgactttccaagtgttcccaaccctcctccagatgagatgctggtctgtgtgttcttgctgcttcccctggggcagattcctcttgttttccccagttgttccctcccacagctctcataatctctgttggtgtccccaacttccagatctgctgccatgacctgcagattaaagctctgattccgtaagaaagtgaggggagctgcttctcaatagagctttgatgggaacctctgttcatacctcaattcttaaggggctgcaccagtgccctaggatgctgattttcatggcttgctcctgcagggtaatatcttagttttgtagtggggatcagagaactgggtctggatgcatttcagaagtgtgagctcattctctcccagacagatactatgggaaaggaagatgttttgcaggggtaaatgattcaagagattagggcaactctccagtatgaggtcccttagaatttctcactataacatgcctaacacactcgacttcaagcaatccagtgtatatttgttcttcatcttgtaatagcctacattttatatgacagcctctgcctcagggaatttcatactctggcttcattactctctacaggaacttgcctctccctagatttcaaatattttgtttgttttcaaccctcaattatctgaagcattaagtaaaatttgcaaacttccatcttttctgtttatctgttattgttgatactattgttgtaagaatgaatatatgggcccggcgcggtggctcatgcctgtaatcccagcactttgtgaggccgaggtgggtggatcacgaggtcaggagatcaagaccatcttggctaacacggtgaaaccccgtctctactaaaaatacaaaaaattagccaggtgtggtggtgcgcaccagtagtcccagctacttgggaggctgaggcaggagaatggcgtgaacccgggaggtggagcttgtagtgagctgagatcgcgccactgcactccagcctgggtgacagagtgagactctgtctctaaaaataaataaataaataaataaataaataaataaatatgtgtgtatatatatatatatttctcatctatgtacatttttaagcttagcagcatattttttagtgagatccagaataataaaagaatccaaacatttttcagctgcctaatagagaaacaaattctggtaaattttttcactggaatactactcaacatttataataaatatatttctggtacacagaacagcaaggaaaagtatctaagtatttatgctgagtaaaataagccagacaaataagaatatgtactatattactccatttatgtaatttatttcaaatgaaaaaaatctaaagtaatatacaaaagatgagtagttacctgggaaaagggtagaataaaggaaggggaaatgtggaaacatacagaagaacaagagaaaatgttgaggggaactcacttgtccacctcagtaatgatgacgcttacatcatgttttcaattctacactttaaatacgtgaagtgtattatctgccaattaacactcacaaaatttattgcaagcaaacaaatgaaaaattagaccaaaagcggtggtataaagatacaaaatatccattaaaagtcagaaatatatgagaatttgcctcctgaaccctagttctctccttatttttaggtgaatgctagagtgccacaaaaatcactcaagttctcaatacaggaagtgggttccacaaagcacactaggcatgtccaattcttacctggagttggttcagggagtaactggggccactgatgtggagcacaggccaagctaccagggctcattcatctcagacatgagacacacacagcccctcctccgtgtgtgggtttatttcacatctgtaaatggagaaaccattgacttctacagaacataatttacacaaatatgtaaaaatataatagtgcaaaatgtttatcacaacacattttcataataagacagtgtattttccaaataccataattgtcacccaattcctgcggggccctgtcattttatctggggtctgccatctcctcagggttcccaccccagagctctctgtgtagcaggagacacgcaaatagggccctccccatgctgatgaaaaccagctaaaccctgaccctgcagctctggcagaggagcctcagccccgggattcccaggtgtttctgcttggtcaacactgaacatacaggattcaccatggagttggggctgaggtgggttttccttgctgctattttaaaaggtgatttatggagaactagagctattgagtgtgaatggacataagtgagcgaaacagtggatatgtgtggcagtttcttaccaggatgtctctgtgtttgcaggtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgtgagagatacggtaaggagaagtcagtgtgagcccagacacaaacctcccttcagggtacctgggacaaccagggaaagcctgggacactgtgcactgtgctgaccccaggggcaagtgcaggtgctacaagggctgggtttcctgtcttgatctggggctgccttgttaccaaattacccgagggaacttctctagatttgcaattctgtactaacatttgatgtctgtgactgctaaacttccctcacatatttgttttttgtttgtttgttttgttttgttttttgtaacaggaagacccatcctcacccctacagaagcccgagtgtcaccttgggggcagaaatgaccctgccttggtcacattgatcagtgtcctgaggaagcccagtggaacctggggagtgttttccagtcaggctcagggcagagacctccgtggaaatctctgattagaataggtttgggattcagacttgggccaagagggagtctcacccatgggagggtccttaaatcctgacagtttttacagctgttctccctcctctggcaaaactgtgcacatctgactcagaactgatccagctggcccttacttgctaatcaatttttcttctctctacacttcattctcatagttcccttttcttcccttcccagaaaacagagagtgtgttttctgtggtctaaatctcagggctcaggcctgttacctggaactcaggtgtggcccaggctgtggctcctgtgagacctggggaggctgaggggactttcccactcaccattgcctggacccgcctgctgtcttctgtgcatggaggcatttgggaaatgaagtggacattagtcactgaggggataatggtagctttctcaaatgagatactgatgtagagctgatcttctgtttctcacactgtcacagaatttcctccttcatctgtgactttggggaaagctaaggatggacactctattgtgctgtgagctctgggtgacagcaattggagggtctggctaggcaaatcctacagggtttcaggtcaatggagttggaatttctgggaagacctacactgtcatcctccatggagtcccatcatcatctcttatgctctgatggaatcagccccacctaggttatctaggacaatcttcctgacttaggaaaaaaatgatggcaggctttactaacacttatattataggatcagtacaacacctaggttagtgtgtaactgaataaatgactctatgagtcaaggggacacataaaattgattgttgccatgacatttatttatttatttatttatttatttattggaaaccagagttttattgttactgaaatgagtctcgccaagcattcaagaatgggattttttaaggatagcttggtgggttgggggcagccagtgagtcatgagtactgattgatcaggtcagagataaaatcatagggagctgaaggtgtcttgtgctgagtcagttcctaggagggggccacaagatcggatgagccagtttattgatctgggtgatgccagctgatccatcaagtgcagagtctgtaaaatatctaaagcattgatcttaggctttataatagtcattttatccccaggagcaaactaggaagggttagaatttgtagccaccagctgcatgactcttaaaacataatttctaatattttggctaattcgttagtcccccaaaggcagtctagtccccaggacgaaggagatttgttttgggaaagggcagttattgtctctgttttaaactataaactaaactaagttcctcccaatgttaggtaagcctacacccaggaatgcacaaggacaacctggaggtttgaggcaagatggagcaggttaggtcacagctctttcactgtttcagttgcagctttgcagtggtggcttcaattcctccctttgagttttgaccttatcgacttgttttgtttctctttaagtgatggttttataaccatctatgaaactctaacaggtgctctcacatgcagatttctgattaaaaactctgaagatggttacaatagtatagagataaaactatcaaatagaagactatcttttttgacttttcacttaaaatgttgcccaagaaaacttttcttttgagctatttatagctttcaacaattgagtatagtcctgtacataaaatttggagaatatttgtttctctctgtccactttctccagaatttggaaactctttgtgaatatccttaacttatggcaatatgatttttcataagtgcagtaagattttttttttttttgcaacaggacacaattggagaaactggttattttaccaaggctttgactgtaatggcgtgcttcaccttaagcaatcgaacttgacttatacagccaataagagccccttgggaaaactggcctgtaccttgtccacacagtctttgtacaaggttcctgaccagtggtaagtaaagaatgtcactttctaacaggcccaagaaccccatgttttcctgggaccccagaggaaaaataatttaccagacttacaggtatttgatggtaaaaactcatggctgggcttggctttaaaaaagtcttatctgagattccttatggaacagagttccaccaaagccaattttaaaagcctgtgtaaacaataattatttgtattgtgctttatgcaaataataaggccatgaataataagactaaagtttattttgcaaataaatcagtcctatcttgatttgttttaaataaaaatggggacaagagagaaaaaaattatgctttaaaaatatagtacacctgttgtttgctgttcttgtttttttttcttcagcagtttggacgaaattctaaattatttgtaggctacaaagccataaactaatgcgttcaaatctttacttttaaaactgcgaattgcactccttaccccagttctcattatgtactttatagtatgttgttccctccaatgtggtgctggaattatagatgacagcactgacagctttgccatgcaagccttggaaccccacgcaggcctgcgtgagtacactcagacagttgcaatgaggttccagtcctcttatcttgaggtcagcacctacccctactacgccccaggtcatcaataaaaagttgtaacagtcttggcccttcttacatcttcattatccaacaccatgatttttgttttttgccaaaacaattgccaaatatagtcataatcataggataaataattttgctgaaatatatgtgttattattggtcttttgagatggaaagtccaagactggattatgctttcatgcatttttcataagaagtacttccactcttttgacaggaaacgcacagggggtgacatgtggctgcagaagctgatggcatatggtagaaatctgtccctgagtaaaggagagatggacggaggattgggtgaaacattcttaggtttctgtgctgtgcaaggaaggtgtaaaacatatttgagtctactacaagtcaacattacccaagggggaacccctgtgactccagcaatgactctgcctcagaatcactaaagagtccttcctttcattagagtggaccacaggatctgggccatagcatagacgtcagaaagcagcagcttgacacctgatccatgtgcattttcctgcctttaaagggagggagagaggtgtattctcagggtcaacacactctttgttgatttttacacagaacactggcatttactttatttcattgaaagatatatgaacagatgtgtgtctgcaaatgattgtaattttcacatttattccaattgcataatttttaaattctgcttgatgtcctggcacacagttgtgttttctataggtatttttcaataaatcaagaaaatacattttccactttcactggcttttctccatgtgcagaggccttgagtagatcatgtctgactattagtctgttttcatgctgctgataaagacataccagagacttggaagtttacaatagaaagagttttattggacttacacttccacatgactggaaaggcctcacaatcatggtggaaggtgaaaggcacatctgacatggtggcagacaagagaagagagcttgtgcagggatctccctttttacaatcatcagatctcgtgaaactcatgcagtattacatgaacagtgctggagaaacccgcagccataattcaatgacctaccactgggtccctaccatgacactgggaattatgggagttaaattcaagatgtgatttgagtggggacacagccaaaccatattattttgccccatggcccctcccaaatctcatgtcctcacattgcaaaaccaatcatgcctttcctacagtcccccagagtcaacttgtttcagcgttaactcaaaaatccacagtctaacatctcatctgagacaaggcaagtcccttccacctataaacctgtaaagtcaaaagcaagttacttcctagaaacaatgggggtactggcattggataaacacacccatccaaatgacagaaattgcccaaaacaaaggggccctctgcaagtccaaaatccagcagagcagtcaaatattaaagctccaaaatgatcccctatgactccatttcccaaatccaggtcatgctgatgcaacagatggtttcccttggtcttgggcagctccacccctgtggctttgcagggtacagcctccctcctggctgctttcacaggctggtgttgagtgaatgtgccttttccaggcacatggtgcaagctgtcagtggatctaccacactgggatctggaggatggcggccctcttctcacagctgcactatgcaataccccaatagggactctgtgttggagctctgaccccatatttacctttctcactggcctagcagcggttctccatgagggtcccactgctgcagcaaacttctgcctggacacccaggtgttttcatacatcttctgatacccaggcagaggttctcaaggaccagttcttgacttctgtgtactcactggctctacaccatgtggaagctgccaaggcttggggtttgcaccatctgaagccatggcctgagccctacattggcgtctttcagccatagctggagtggctggacacagggcaccaactccttaggctgcacacagcacgggcaccctgggcctggaccacaaaaccacttttgcctcttaggcctccaggcctgtgatgggaggggctgccgtgaagacttctgacattcacaggagacattttccccattgtcttgaggattaacatttggctcctcattacttatgcaaatttctgcagctggcttgaatttcacctcagaaaataagatttcttttctactgccttgccaggttgtaaattttctgaacttttatgctgtttcccctttaaaactgaatgcctttaatagcactcaagtgggctttttgaattctttgctgcttagaaatttcttctgccagacaccctaaatcatctctctcaagttcaaaattccacaatttgctccagttcccaatgagttcctcatctccatctgagaccacctcaagctagaccttattgttcatataactatcagcatttttggcaaagcaattcaacaagtctctaggaagttacaaactatcccatattttctggtctttttctgagccctgcaaactcttccaatctctgcccgttacccagttaaaaagtcacttccatatttttggttatcttttcagcaatgtctcactctactggtaccaatttactgtattagtctgttatcacgctggtcccaagactggacaattcataaaagaaaggtttattggacttacagttccacatggcttgggaggcctcacaattatggtggaaggtggaaatcaggtctcacatggtggcagactagagaagagtgcacatgaaggaaaactcccctttttaatccatcagatctcatgaaactcattcactatcacacgaatagctcaggagagacccatgcccataattcagtcacctcccatcaggttccttccatgacatgtgggaattgtggaagttacaattcaagatgaaatttgggtggggacacaaacaaaccatatcactgaccttctccgcatcatctctcatgaccccagagaaagagcagagatttgtctggggtaggagctgctcctgtggaacttagaggctgcagacgaccccagtgcagttttatggagtaagagagttttcccatgtctgggaacttctagcatacccactgccagagattgctggttggctgttattgaggggttcagaattagatcacctggtagcctatctcactgcagccccattgtgtaacttaccaccaatggccttcacgtgaggactcaatgttaactgttctgacctcattttcttacctcctttatttgtaagtttggttacagatttttttttactttaatttcagggatatgtgtgctgaatgcgcaggttttagtttcttattcaagccttataattgctcaactgatcaggaataatacaacatgtatgcagttttggggaaatataaatgaacatccatgcaaaattttttgtttggatatgtccgtcagttacacccctatgaacataatagccggtcctcaccagaaattgctggtcctcaccgatctcaaaagcatctagatcttcaacttcctagccttgagaattcagaaaacaatgtttatgatatttctgagccacccatttaatggagttctgttatagcagctgaaacagactaaaccatttaccaagtctcagtaagggcagtgaggatccaccatgcttgagagacaagcattactctctcatttgcagctcaggatgacagaagcatgatcatgagctgatctgaaaagaagatgtggctttctctccctcggatctcagttgaagccatggtgtcacatctctatggtggagactaaattccagtctgtgatgtaatggatgcctgcctcctcccaccctcacttacgagacagagtttccatgccatgcgttattgaccaagaaccaagaaggactccaattattctcacccctgctcacttgtatggcagaggttctggggatattcctgggagaggcataatgagactatttaagtccacgattcccaaacagttttatgctcttaaagcaggagtatcactttgagatatatgaataatttcatgtgcactaaggtggaggctgttatatttttataggtaaagatgcatggcataaagacagagatacagcactctggaaattgtgtgactatgtttgcagttgactgtgaataatttttaccatgaagttatcctaaaacacataatatatttttactgtaagtaattaatgaaaagctgacagctccacaagagcaatatccacttggtttagcagagagaatgagaaatagcataatttaagaataatcagttagacactgtgccatgtgcctgtattttcaactagtgaggatgctaatgtgggaagatcacccaagcccaggatttcaaggccagcctgcaagatattgctagacccattttcttaaaaaaaaaaaaataacattctgggtcatgacaaacctcaaaaactgaccctctaaataggaacaaatttaattgcattaaaatgtggatgaatttttgacacaaaacagtgacagcatgccagcaatgagtacagaataacatccagttgttatgttaagagatacagactccgaaaaagagacatcaggtagaggctgtcaaaggcctcactgcctaatgactgcttttccattgatactgtgtgtatatcccggaatgcacctgtgaatgaggacatcatgtctttcatagtgtgagagaaagagacattactacccatctgacaaaggattgatcagaatataccaggatctcagacaactctataggaaaaatatctagtaatccgaataaaaagcaggcgatatttatttcttaaaataagactttcaaattgcaaacaggcatataaaatgtgctgtgtaacactgatcatcagaacaatgcaaaacaaaactacagtgaaatatcatctcatctgattttaaaatgatttcatccgaaagccagacagaaacaaatgctgggaaggatatggagaaatgagaacactcataacctgttggtgggcacttaagtttataaaaccactatggagaacagtttagagtttcctccaaacctaatagtagtgttgtcatataatccagcaatcctgctgctggcatgtactccctcccacaaaaaaaaaatgttgtttgcactaccatgtttgttatagcactgttcgtaatagccaaaatttgaaagcatcctaactgcccattaacagatgatggataaataaaatgtggtacatatagcatatggattaatattatgccataaagagaatgagattttttcatttgcaacaacgtggatgaaactggagttcattatattaattgaaataatcccagaaccgaaagacaaacttcacatattctcatatatttgtggaagttaaaaattaagacaactgaactcgtggagatagagagtgaaaggatggtcaccagaggctgggaaggtctatggtagatggggattattggggatgctcaatggatgaaaaaagtggttagaaataacaaataatacatagtatttgataacacaacagactaagtataatccttaataacataattatagattgtaaaataactaaaagtgtataaatggaatgttggtaactcaaagaattaatacttgaaaggatgtaggaaccattcatcataatgtgagtattatgcagttcatgctatatcaaagtcaggtaccccataaatatacacatataccatttacccacaaaaattcaaaattaaagtatttatgtatctcatcttctgtatctatattacattaaacctaagaagatactggtttcttcacactaccaagatccacatagacatccgtagcttctttctttgcctgtccataatctgacattgaaaaatgaggaaacctttcctatcatatgacattaatttacttagtgcacaatttcaaaatacacaaattgtgttagaattattaaactgacccttgttgaaaatatgtttatcgactagaataccgtgcttatatgcagcttatttatattttacaatcacaacatcaaattatttccaaagatacttgtttctgatattcatgcccccctttctgcagtgaaattagtacaaacctgtttatcattgttagatatttttatacagctttcattttattctgtgtttcatgaccagctaaatacttttgaagttgtatgcatttaggttaacactttgtctcaaaaaattatgagttttcacaaattatttatgccatgtgtttatcattgaacaccatgaaaatagtttcattgtgattaaaaagtgtgtgtttcacctaatccacacaccttttccccagattcctggaaaaccacaaaggtttactggatctatatttttgtctttggcaaaatagcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgtgagagacacagtgagggacatatgggtgagtctagacgcaaacttccctgcaggaagacaagaggggactttgtggtaaatggtgctcagaaccactaggggacactcagaaccactaggagacactcaggatagcagaaggtgctcaggatgccgcagggtgctcaaaacactaggggtgctcaagaccagcagggggcactcaggacaccaggagacacttaggacatcagggggcgctcaggacaccagggggcgctcagcacaagcaggggccacagaatgacaagggtgcattccagaccaccaggaaacactcaggaccaacaagagattctcagaaaccaccaggtgtaacaggaccacctaaaggcccacaagacaaccaggagacactcatggccactgaagaacattgaggacaccaggggttcagggccaacagggagtgctcggggccaccatggggctttcagtaaccacgagggaatcaatcactcaggacaccacggttttcttaggaggcagctccacatcaggtgcctggggaaggtgacgtttgcttttagacctagctgattcctgagctggtcaagcaaaagtcttcccacgatctctcactatttcttccttgtaacccatggtttctttcacatacaaatcattaacttaggataggaattcaattcaacttttaaccttgcatatttttagaataataatagcaatagtaattcaatgtgttttgataataagaaattgtgtatgcctaattcaaactctggttccacgcatgggtttttgtttcttgtgctgtgccagtcacactacagtcaatgcttttctaataataactcaacaatgtcacggtgttaagtttcctttcattttgtctgccatttgtggagatgaaacaccactttcacgggtcagttcctccactttggttgggttctggtcttctgctcttcacactgtttctccaccttcccttctgtcaaatccttttgtcttcctcagtctcctggcaaagaagcaacaaatctatttattttgtctcctccacgtctggtgaatctgttcacttctcttcatgatcattgaacccaaccatgtttagaaggataacagttcaccttacaatatgctcatgtaggtcaggtgcagtggctcactcctgtaatcccagcactttgggaggccaagacgggtggatcatctgaggtcgagtttgagatcagcgtggccaacatggcaaaaccctgtctctactaaaaatagaaaaattagccaggcatggtgtcgggcacctgtaatcccagctactcgggaggctgaggcaggagaatcacttgaacccagggtgagaggctgcagtgagctgagataatgccacttaactccagcctgggcgacagagagaaactccatctcaaaaaaaaaagcatatgttcatctatccgcagactctctgacatcgtcacccttttctagggtcctgcagacatcaccccacaacatccagtccttttcctaagtaccacagagtgggctctgcagctcctgctgctctctgtgtgctcagcgctgaggctcaccagtgctttgatgatgaagttcaaatccctaatgtgtttgcaattctcagacaaccctctagcaagctgccattgtgagtgcattctggggatcctgggctgatttcaggtccatattgctggatgttctctagcatccaggcgtgttggcaaataaacatctagaatttgtattgaaaatttgtggaaaatcaatggtagaaaacaatcctaatttctaaataagaacattttatcctgactttataaaaacacaatgttaatttaaccaataatgtaataaaatgtgtttaaagtgatgtttatcttgttattagatgtattaataattggtattttaaagtatactaacagcataaatgacaaacaaaccaacacagcgattatacataaataccattgtacattaattaatttggcaagaatggcatttattttcatttctaccaaaccttgcctttaaatatgtttgttaattggcattaggatagtgaaacaatcacacagagcaacaacattttggaatattacattatactataaaatagtacattcgattcaattatataattaaaataacattaaataaattcatgttttggtttgatatttggatatgtgttcatttttgtattttctttttttgtatcttttgtagagatggggtttcaccatgttggacaggctggtctcgacttcctgacctcaggtgatttatcgggggaacccacccccaatatttcaatgtagggtctttctattttctgtaagtgtcggctggtctgagaaataaagagaaagagtacaaagaaaggaatgttacagctgggccaccgggggtgacatcacatattgataggtccgtgatgccccctgagccgcaacaccagcaagtttttattagggattttaaaaggagagggggtgtacgaacagggagtaggtcacaaagatcacatgctttaaggggcaaaaagcagggcaaagatcacatattccttccccagggtattaattactaatattccttgctgggaaagaatttagtgatatcttccctacttgcacatcagtttataagctctctgcaagaagaaaaatatggctctattctgcccgaccccgcaggcagtcagaccttatggttatcttcccttgtttcctaaaatcgctgttgttctgttctttttcaaggtgcactgatttcatattgttcaaacacacatgttttacaatcagatttcatattgttcaaacacacatgttttacaatcaatttgtacagttaatgcaatcatcacagggtcctgaggtgacttacatcctcagcttacaaagataacaggattatgagattaaagaaattatgaaagtattgattttgggaactgataaatgtccatattaaaatgaaatcttcacaatttatgtttagagattccagtaaagacaggtgtaagaaattataaaagtattaattttgggaactgataaatgtccatattaaaatgcaatgcctagggccaacaaaggagtcatattaatatgaaaaataatagctgaatattttggaaatgacacatgcagtaacaaatgtctatatgaaattaagaagatattgacacaaaattgagaaaaaattaacataattatgctcactactggtttataaaatgcctataataacactttttaaatcatattatagaaaataaaataactatataaatagcactctctttgcttgattttagtatttggtgcttcaaatgttttttatacaaataaacattggtcattttttgatggtaatttcaatattttcttccagaatacatgttcataaatgtaattgaaattgtataattttcagaaacttattttatcagttgtgacttgtatttttatgatagactttttacatttatatacttttgattcagaataattatagataaaaaaattataaagttaatacagtgtgttcccatctccaagtatctcctaagatgaatatcctctatcatcataagacatggtgttaacacatttacattgataagtgtaaatatattcaataccagaccttattttatttatcatttttccaataatttctattgtaaatgaaaaataaaattctaagcttcctcaagcaactaaatgaactcaaccctcagccaagggaatttcaaagtaaattctaaaacttgttccagcaatgatgggaaagtgagaggtcagacatgcctcattacatgctcctctctttggaattaaggcaccagtggccagcattagtactacaacaaagatcttaagacgggcaaaactatatttttgctgtaaacactttctatagcaaaaagacatcaaattacaacttgattctagtatagcatcacatgacaaatagcaaaacctaatgatttattctgtatgaaatctgctacctggaggcttcatctacataataagaactatgatctccaggaccccttatcttaatccagacactcagttgtaatgattgtattaccttacatttcaaccaattgccaatcagaaaatctttgaattctcctatgtcctggaaccctgtgcataaactttcctgcctttctagactgcataaatggtatagctcacatgtgttgattaatatctgcctgtaacttctgacccactaaagtatataaaatcaagctgtaatcaagccattttggacatgtgttctcaggaattcctggggtcgtgtcatgggccttggtaactcatatatatctcagaatgagccattttaaatatttcatagtttgtcccttttagtggatatcttcttttcttttttttgggacagaatctctctttgctgttgctttcgtatatttgtttgtttccagattccatcaaggccatcagtttgaattcagttgtcttgttcctttattctcttctggtaaatgacagtttgtatttctgaagttttctagttgaatattttatagataaaaatttatcaagtaggttgatagtgccatttgggactcttatatctttacctatttaatcattgcttgttttctcaatcacaatgagtgttgatttctccatgttctatacatgttagtctattttctgttccaaatccatttattaggtcttttaaaatggattttggaaaagttgatcctattattttatgcaatatttcacttgagttgcaaaggtattctttttatgattattttgtctgaaattaacatagctattcaagttttctttggtttatattttcatggtctatatttttccatcttatttcttctctttgtgaatatgttaagaagttttcttggagaaagataattgctgggtcttttttttttttagtcaactatgaggaattattttttaatgatattacccttttgtccaataatggttgttttgtctttttacaataatatgtattgtttctattaatttattatttaattattattgatgaatatcttattggttaccataaggataacaataagacatttctataattgaattctaattcaaaaatgtagtacttctttctctttcttatttctttgagacggagtctcactctgtcgcccaggctggagtgcagtgggacaatctcagatcactgtaagctctgcctcctgggttctcgccattctcctgcctcagcctcccaagtagctgggactacaggcacctgccaccatgcccggataattttttgtatctttagtagagacaggctttcaccgtgttagccaggatggtctctatcttctgacttgtgatctgcctgacctggcctcccaaagtactgggattacaggcatgagccaccgtgcccagcctacccctttatatatagaacagagatattataactatatatgtctaattcctcttttctatcccttttttattttatcagtttgtaattacataagctataaaaatgtaatattgacatttttataattgctttacacatttatgtaataaagaaaacacaaatgcaaaaactaaatttaaacctcatttttttcattgttgacaatctttatcttttggatacattcaggtattggatgtatatcatatggctgctcatctagaaactctgctaaaacgtctatggcaagattaatatgctgggaatagattttctcaggatttgtttgtccgacagagtatttatttgtctttgatttatcatctcaagagacaatgtcaagaagatgctgtttctgcaaatgggcaatctgcaaaccaaggacacgtcactacattactgtgcaagagaagcacatgaggaaaggccggtgtgagacacaaacctccaggaacacctgggctaatgagctgcagggggcgctcaggacccactgatcagtcaaccacagaggggagtgcaaaggttaggactgctttcctgcaagcattgaaaaaagaagaaaaaaactccgtctgacagtttctccaaggaacttctgtaattttagaattctgtgcctaccaatgacatctccaaatatttttttaaaatattgtgtttggaggacatactctcacatggacaaaacacaaattgacacagagatgaaaagccctcaaccatagtcaccaaaattggagacatgtagaagctcactgggacctgttgagtcttctccaatcacactcagaacagagaccttagtgggtctcccttagagtagtcattaaggatggtgataacagcctaaagatggtagaccatggtcagtgtcatatagaatatggggaccctcacaagttttttgtctgacccttctcctgacactaaattatgcaaattaataacactgatctggtgcttcttttgattctaatttattttatttttagttgtcgttctcacttttcctttggattttcctgctccctggaaaaggtaaatgtggtctccgtgacctcaattcaagggctgaagccctttccctgtagctcagctggggctcaggctgtggctactgcagccatgtggaagaggctgaagggactttcttcactctccttgctcaggaccatccactgtattgtgtataggcttctctggaaatgcaagtggccatttgtagtgaaagaaatatgtttgtctggttaaaatgggaggtggatgtagagttaattggctgctacataaactgtccttctccaccagtgcttttaggatgagattgtgaaatttgtaagaatcaaaatggagtcacatatgttaaaaccctgacaaatggattcaggaagtgtagggagaattcttacacacatatccctgacaacaagaactatcataaaatagttcttgcaaaaagaccaacatgacctcataatcatgacttctgcaaagacttctactcagaatctacttgcccagccttagattaatgccatctgaattacactgatcatgttactatcactggtcctcaccacagatgcaacaccctcctgagtcctgaaacctgactccatcccatagagtagggcacagatgaggggaatgcaaatctccaccagctccaccctcctctgggttgaaaaagccgagcacaggtcccagctcagtgactcctgtgccccaccatggacacactttgctccacgctcctgctgctgaccatcccttcatgtgagtgctgtggtcagggactccttcacgggtgaaacatcagttttcttgtttgtgggcttcatcttcttatgctttctccacaggggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagaccacaaagacacagcccagggcacctcctgtacaaaaacccaggctgcttctcattggtgctccctccccacctctgcagaacaggaaagtgcagctgagatacgttttcctgccagggcctgcatttcccatccccattagactcagagccctgtcttcctccttcttctttaataataaatggcatgactcctgttaatagttcatagaagcagaagctgagtcctgtttgtcaaacattcagcatgaaatgttcatgttacctgggccagatgcatcactggtatgtggccgccagtttaatgggctcatactactccaagcggccgaatacaaaacagcagaacatatgcctttattaaactgcaggaaatgacactggagaaaaatgtggggataagggagcaggaggaattgtgaaaattcagataatagcttttctcgtagagagaaaggtgcgttaataaaataattttataaaacaataaaacagatggaatgtgtccccatcacggagtgtctcacagtaacagtgcagaaataaatttctaaaaatgtcgtagggtaggtgtgatagacaaggcttatttccacacagggagcccataaatacccatgtaattaaaaatccagctcttagaaagggagtgcctcaacttgacatcagaaacccacgtcagtgagtctgaggagcaatgtggaaaagaaatggaaaattcaacaatacctttcttatgaaaatcctagctcacgtttcaacatgaaacataactgtctacaattttaggaaaaccatcccatggcaacaagtcactacactcaaaaggtactgagctaacagagttccagcagtgagcaggtcagtgctgaaatccccggagaatcaaggctctcaggtacgttgtacaaaacccagaactgagccacacaatctatggtcaagtgatctttgacaaagtcaacaaaaatatgcacggggaagaggccacgctcttcatgccatgttgctgggacaattggactgccatatgcagaagaatgaaactggacaccaacctgtcgacatatacataaccataagaaaatggactgaaggcttgattataggacttcaaaatataaatgtactcgaagaaaacaccaggagaactcctctggacattgggcttagtaaataatttaccacaaaaacctcaaaagcacaagcaataacatcaaaaatagatgaatggaatttagttaaactaaagagcttccacacagcaacagagtgaacagacaaattgcagaatgctaaaaaatatttgcacacattgcatctggcaggggactgataggcagaatttacacggaactgaaacaaccccaccacaacaacagctatgaaaaaacaaataacctcattaaaaattggcaaaggacacgagtaggaatttttttaaagaacacatataactggacaagtgctaaacatcactgattatcagggatatgcaaattaaaactgcaaagaggtatcttacaccagtcagaatggctactataaaagaagcaaaaatagcagacatcggtggcgatcaaaggcaaagggaagtctcagtcattgttggtgaggatgtagatgagcacagcctctatggaaaacaatgtggagatttttcaaagaaataaaagcagaactacctttgattcaatgaccccaccattgggtaactacccaaaggaaaaataaatcatcatatcagaatgataaccaaacttttgttttcctgcagaactattcacagtagcatagatatcaacctaaggaattaacctgtgtcttacaacagataattttatttaaaaagtcacatatatatacaattaaatactatccagccatattaaggaatggaatcatgtattttgcagctacatggatggaactctgggtcattattttaagtctaataaacgagaagtagaacagcacacaccacactttttcacttataaatgggagctaagtaatatgtgcacaggcccatagagaaaggaatgatggacattgcagactcagaaacatgggagagcagaagttgggagaatggtgagaaattacttaaagggtatgatgtacattatttggatcatggatacattaaagccaagacgactatgcaatatatatatgtaacaaaattgcagtcactccccgtaaatgtatacgaataaaataaaaaaaaatacaattgaaatgtgaaattattaacagttgatcaacaatcctgaaaattaaaacgtgtgatgcaataaatgaaaataattttagttgaacttcatcaaattttaaaacattttctattcaaccgactatcaagaaactgaaggacaagcttcaggggagaaagtatttgcaaatcatacatctaacaatgtaattataataagaaccctcaaaactcaacagtaaaaagaagcaatctgtttataaaataggcaaaggtttgtgcaaactttctatcaaagaagatgtacagatgacacatcagcatatgaatgtaattttccagtagagaaattcaaatcaagaccaaaaggagacacgactttaggctttagaatgaggaaaaataaagaagaaatactgacagtaccagtgtcagtgagcatgccaggccccgagagactaaaatattgctagtgcaaaatgaaagagtttctgggagaactgtttacagtttcttataaaattaaacatgtccttaatccatgacctagaactctcatccctgagtatgtcctacaaaggattaaaatcatgtgttcacacacacacgtattcagatgtttaacattgtgtgtgtgtgtgtgtggtgtgtgtgtgtgtgtgttagaaactaaaaacaacatgaacatctttgaaaatttgacacaaaccattacaggtgaactccagactttcttctgagtgacagaaggcctgcctgaaagatccccagagacacagtcatggatttcactgtcaccctcacatgtcactggcttgggctgggctctctctggctcttccctgaccaggaccagatgttgagctccactacctgcagttggaagtttatattttcaacaatgcactgagggctaagttgctctacagactgaaccaaacaaacatgggcgcctttgaacaaacagtgcctgacatttgtactgaccccaggagaactcttcccgctctctttcttcttggttctctcctgcaggccagcagccctgcagtttagcctggacctctcatgcatctacccatctcctcccaagtgcattttaccacagcctccactgtttttgtaattctccacactctgttgtaaatgaagtcaggtccttcgagaccagattcgggactctattttatgaccaaatttcagcctcacccccactcctgagacagagctcctaaataagattctgcaggtggagattaagagcgtttttcttcctcaatgtaggagatgagtgctcagtggagggatggggaggagctttccactttaccagcatgcagatcctgctggggtggaccctctgccataggagcagggctgggaaccaggcagccaatgtcctcctccttggtgctgcactcagggcagagcctgcatccatgagtggggctgtgtggaagaagtgagtctctggttctcagtaagtcttgtctagaactgagcctcagcagcatgacctgtgggcaaggtcggagggccaatgtcctggcccctggggaagagtgtgctctgctgggagctgggcagaaggaatcctgtctacttggctgcagccatctgtggtggaatttacatcatgctgagctcgggcatagaaggaaggaagagaatctttgatcaaatatcaatatcatgtctgaccttactgaggttttgtagattatctcgaataaatgttccttcactttctgtatgttgacagggcctttccagacccgttaatttttcaaaattaatctcaccagtttcatggaggcatggatatatcgagctccttataccgtcatgtgagatgtggaactgtttccttcactggttataaaataatgggttgacttttttcccaacactttacagataccatcaattgtcctattgcttatatggttataaccaaagcaatgctgatattattcatttctattctattgcaaggtatgccccctctactcgtctccaattgctggcatgtatttccatttgtctgtatgttttagtaatttgaatatgattcacctaagagtgtttgtgtgtgtgtgggtatgtgtgtgtcgtgtgtgtgtgtgttaagggcttatcctgctatttggtgttctctgacctgcactgatccatgacttacaatttctctaatttggaggaaaaaatagagggaaagtgagtttgagtccagacacaaacctcactgaagtgagcacaggattctaaccccaggggtgctcaggacacgctgatcacaagagccagcctcaggggcaggtgcagatggaggctgagctcttctttcccgtcagcactgtggcttcttctccataaaacatcttcccttgaggaatttatctgaattcatgattttttgcttatctccaaagtctctgaaatgaaaatgtttgttttaataaaagaaaaatcttctcacatgtgtaaaagacagtttcctacagtcgcttaatcttgtctttaaatgtcaattatcaatgcttctgaagtaaatcagctaaatctataaaagacactttgtttaactcaacactgcagcccagcatgacagcactgaaagggccagcaagcagcaggcaggatacggtgcatgccagacactggggcggaaggagttagtatccagtgcaagagaagaaagtgcccgtggtggtcactgtcaggacccaagctcacagctccaattgcaggtgaccccatgcaaaggaagagataccctcaccaatgtttagtgtggatgtcgagtctgatggtgccacattcacacaccacgtgaatatggaaagatttaccaactccattattgaggcgtctgctgagggctgcacaggcctctcaataaagtccaaactggctcaatagagcaggaaagaagctgcctcagggtttttatgatggtttggtgttgaaggaatggtggggcttcctactaaggggaaggagcttgtataatttgaacctaatactggcatccagtgaggacacttccatgattttctactaaatttcccatgtgtgggggacaaaagtgaaggaaaaggattaatcctgtcatcagtaatgaggcatcaaaatagagtctgatgacttattctacttagcaacttaagcaaatgagtgaaaaatgaggtaagtgttcactctgggtggacagcaaataggtctgcagaaaatagagtttttttaagtgtaagcacataacaaaaagaaagagaagaacaaattgaacagggatcttggaccaatgtcctgggtggaagctcttcactctgtgagatcatcagcttgctctgagggtctcgggtcaagtccttcttcaatatatctcaggccttacaggatacatgggaatgctcagcttggtgtccttcactagggaaaagaaagagaaatcagactgtcactgtgtctatatagaaagggaagacataagagactccattttgaaaaagacctgtactttaaacaattgctttgctgagatgttgttaatttgtagctttgccccagccattttgacccagccactttgagccaacctggagctcacaaaaacatgtgttgtataaaatcaaggtttaagggatctagggctgtgcaggacgtgccttgttaacaaaatgtttacaagcagtatacttgataaaggtcatccgcattgtctactctcaataaaccaggggcacagtgcactgtggaaagccgcagggacctctgcccttgaaggcggggtattgtccaaggtttctccccatgtgatagtctgagatatggcctcgtgggatgagaaagacctgaccgtcccccagcctgactcccgtaaagggtctgtgctgaggagggttagtaaaagaggaaagcctcttgcagttgagatagaggaaggccactgtctcctgcctgcccctgggaactgaatgtcttggtataaaacccgattgtacatttgttcaattttgagataggagaaaaaccaccttatggtgggaggcgagacatatttgcagtaatgctgccttgttattctttatgccgctgagatgtttgggcggagagaaacataaatctggcctacgtgcatgtccaggcatagtaccttcccttgaacttaattacgacatagattcttttgctcacatgttttttgctgaccttctccttattatcaccctggtctcctactacattcctttttgctgaaataatgaaaataataatcaataaaaactgagggaactcagagaccagtgctggtgcaggtccttggtatgctgagtgccggttccctgggcccactgttgtttctctatactttgtttctgtgtcttatttcttttctcagtctctcatcccacctgacgaggaatacccacaggtgtggaggggcaggtctccccttcgtacttgagcagccttacaactgggtgggtttatgaattaattcctcggttgcattacatgaaaaatcacacaatctacaaattttaaaaaataagcctttactttttataaaagattacagccatttcacaggctgggaagcacagccattggtgaagacgagagacaggcactcccaaggaggagcggtggggcagaaactttatgctgaacgtgttggctaaacagacataatcaacggattacaggaggggctatgcgtgttcataaaggtggtcatgacacatgaatatgggagcaaacatacacgtcacatgtgacccacttagcagtggggacttagcatttaaatgtgttacagttaggccctaagtgccaaaagctggagcaggggcacaaagaccctcagagcgcagcctccataaatggccagaaccaggccatggtcagtggtctctgatcaggagaaaattcctgaaatcaatctggtgtcccatccaagctggggttatggctgtggaatggggggtcagttagtcaggggatgagctgcagttggttaaatcgtgcttatctcaggatcagtgcttattttgctgctacagaagaaaataacagtttattctttaagagttggggtgagggatgtaacccctgcctggcatggccttaggtcttgtttataacggggcatcttattgccccggagaatctgttctgtcagtcttatgatctccattttaatgttagtgttggtccatgttgtctctgaaccacaaaagggagtgggtataatgaggtgtgtctgatctcttgttctgcccagctgggaactcagtttttaggtgtttttggtgcctccttggccaagagggggaaccactcaatctcatggggtgactgaaattttacttttagtttaaagtttataaatatggacctaagtattgacattctaaaagtcactcctttgttttggctaaaagtacttggcaagagtccttgaaatgaggttcaagagcagtattttctcatgactttatttgcaatagacacatgagagactgttgaaaagatgaagtaccaaagtagccttaatctgttggtgaatggagttggtataatacagaaatcactttcaatattttgtaacacatgcatgcatgcaataagacagcggtgagcactgagtgtaaagtctctaaaggtacgatctttcagccaccaaataatagtgtaataacggacatactctggaggagctgactataataccgtaacaccacggggagaaactttggccaaggaagtccaagattttcttttccttttcctttttttttttttttttttttttttttgttgttgttgtttgagacagagtctcactctgttgcccaggctagagtgcggtggtgcgatctcgactcactgtgacctctgtctccctgattcaagcgattcctgcctcggcctcccaaaagctgatattacaggcatgtgccaccacacccagctaagtttttcatatttttagtagagacggggttttgccatgctggccaggatgatctcgcactcctgacctcaagtggtcctcctgccttggcctcccgaagtgctggtattacagcgtgagccaccacacccagccgagattttcttaaagttttgaaaattttaatttaagggttacaattttttcaacatttccagaaagctgtagacagtattattctgtgttatatgagtgattgtagttccttccatttttagatagtattacaaacaattttagggctgcttgctttaaatagatagatgatagatggctacatacatacatacatacgtacctcgatagagatatagttgcaaacataaatacatagatagatagagttacagatgtattttagttattatgctacttttttctttgccttttcttcctatgttatgttagtcaggtctccaggacttaggagtgcatttacaatcccttcccttgtccattttgacgtgttctagacaatgcgagaatcctttgtgtgtggatcacttccaagtcatgcactacccttgcaataaatgtgtttgtgtatgtctttgccttactgacaagctctgctgagtgcagttatttctgccgtctgagctaactttacacttggtagagaaatatattctagatggaggcttccactattaatttaaattactaattcataacctccagcttaattattgaggtataatctatcagagatggtattagaacaaaggtttccaatgaaatctaacagaagggatgtcaaaaaattttcctaacttaggtaaaataaccctgagcccattcttagtatccagccatgtctcctatctatcacactgaatcccacactaactttgacctgacttgggacttgtaagcttcaaatatgaccttttgattgcaatgcctctaattcaggacgtgtggttattttagccaagagtaaagaaaaccaaatttaactcgctaaaaatgacaaagattaaaacctaatgaaatggaaactgggatatgagtggctccagacttggctattttaagagtctatgtgcccaggtgatttcttttctccattttacacacaggcaaacccaaaacgtcagcttcatctcccgttgactctcatcatctcgttcttcatcagcttgcttagaatgttgacttccagctgcatccatgttgccacaaaagacatgattttattctttttctgtgaatgcatagtgttccattgtatacatgtaccatattttcttgatcaaattcaccatgaatggacacataggttggatttatgtcttaggtattaagagtagcatagcaatgaacatgtaagtgggtgtattttttggtagactgatttattttcttttgtgcatatacccacatatgagatggccgggccaagtggcagctctgcttcaaatacttttcaaatctccagactgctttccacagtgcttggactaattcacattccacccaacactgtacaagtgtttcctgttctccgcagcctctctccagactgctttccaagattcctctcctccactttgacactttggtatatccatgtgtgtcctctctggttcagccagggacagagaaccaggaagacatcatgcattttctagagggagctggcttggggaatcaacgaccggagtagaaagtgcctttgtccatgcatcacaggcctgagggccctgggcaggaggtcaggaagagaggatgaccagacagctggggaaaccgggatgaataaagccagtttccttcctggtgaggaggggcaggtcgaagcctcgtgtccctgtagggatgaagcacactcacctgccactgctacctgccaatcaggtgacctgcagagcagcagctcctgagtcactgatggtgacttcctcctcctccaaaccctctaggatctgtgcttctcagagtgggaaccccagcaggtccccaagttttcaatggattcacctagctagtgtctctcctcagccccatccccaggctcctgccctggtgctgtgtacagtgtcacaacaggggtgacagtaacagctggtgcctgcactttccaggccaagaagtttgaaagaagcaagtcacagggccagccgggatatggggtaatcacacaaatttccttcttggaggaagtgctgggaaacatccttgagtcctcctcagctcacgtgcagctgctgctgttcatcccagtgcgggggacacatgagccctccccatgcccaggatggagctgtttcaatcacagcaggatgggaatgtgtcttctctatgggggcttttgaagcacagctctcctgttcctgagatttgagatttataaagacaagtcccacagagtggacctgcacaaataagacagtacaggatccccaggagagacatcccataagagaagggacaggcgggtcccatcacagacactcatcctcagaaaccctgaccggctactcaccttcacaggtccccagttcctgatcagtgcctgtgtctgctcctgagaagagatgaaaactcaagacaaatacttctcatgatcataggcttaaaaattctcaacgtaggaaatcaaatccagtagtttatcaaaaagttaacacactgcaatcaagtaggctacattctgcaaaagcaaggctgctttaactgctttccacagtgcttggactaattcacattccatccagcactgtacaagtgctttaacctatgcaaagcaataaatgtgatgctctactaaacagaatcaaaagcaaaaaccatgtgagtattccagcagatgcaggaaaaaagctttcaatagaatctaacaacgcttcatgataaaaaccctcaaaattatagacattgaaggagcacacctcaatctgatgagccgtctatgacaaacccatggccaacatcatactgaatgggcaaacactggaagcattttccttaagaacagaaacaagaaaaggatgcccgctctcaccacttctattcagcctagtactggaagtattcaccagatcaggcaagagaaagaaataaaaggcatccaaataaaagaaaaagaagaatgcaaaccctctgttttcactgataatatgattctatatgtagaaaatattgaaggctctgccaaaagtctcctagtattgatacattcgtttaggaatgtttcaggatataaaatcaatgtacgaaaatcacagtaacatttctagtcaccaacaacgttctggctgagagtggaatcaagaacatgctctcccaatagccaccaagacagtggaatacctaggaatagagttaagccaatgagatgaaatatctctaccagaaaaacagcaaaacacatgtgaaaaaaatcagagataaaacaaataaatggaaaaataaacattccatgcttatgaatttaaacaataaatatatgaaaaagttttaaaatttgtgattaattctacgtagcaatgccatttttttcaacatttacagaatattgttgctggtaatagcagtttagcatttgagtaatggaaacaccttacagaatcactttataacagttgcttcctgtagtgggttgcttcagttacctgatgaaaacatctgcatgtcacaggttgaaaacataaaatatgtctatcaactgagaaggttgtaggcttttgtcaaggaattacttcaagtcattcagaaaaacagcagacagtaaacgaaacttgttcaaattccatggagagtcaaagctgaagaaaatccaactagaagtgtccaaaggcccccaaggctcagttcctcggcaagtcccaccttctcaggttttccagaattttgtttttaactgatttacactgagtgaagtagattaccaggagttttccattattttaacataaaatcgggggctaagtgttgttattttataaagacatctttgaatctctcaggaaatttacctcctgagggttcagataagatcctactctaggttaagattacatgtttggcgcaatgaactggtacaaatcttactttagctttcatgttatctatttttccgcactgacttccacctttttattagtcaagtatatgggatggaagagtgcttctaagaggtccttaacttgcccatttcaatggattttcaagaagacatgagaaaccactttgtttgcaaagcatcccaaagccatgtcctgctccagaaacgtgatctcatttcctggtcgtttcttaactgacacgctctaatcagtgcatctgggccaatttgaaatgaggtgaagaaatgtgtcctaaagtaaagctaacattgtaataggaattcgtgtttaaaaacatttagttttattattgggcaggatccatcaacatataacagttgaagtttctcaacaggagtttaataaatataaggaatgtacagaagtgtttcctaatttaaataaaatgtagtgattacctaggctgtgagtgcaatcttggtaatcttctatgtccatgcccatcactctgtgcaccgcaaactaattttgacctcagcagaaacgggattaattttcaaattagtaatttttttccaatttaatttatttagatgattatgaatgactattttagcagaaagagaatcaaggaaacttgaactaaataaccagaatttaaaatgacaaacaattcaacaagatgccaggatgtgagtggctccaggcccaattaattcaaaactttatgtgcccaggttctgtattttcccaaaattacacatctccattccagcttcatgccacagttgactcccaccgtgtaagacatggcgacaccattcccaaaggtcgtgtgcaattctgaaaatggaataagcaaggagaggagatgatagtttatattctcctctgaggaggaagaattgcctcaacagaccacttctcctgcatctgtgactagaactatgtcacaggcacacatggagcaaaatccctcaaggggataatacggtaacattaatcagggtgatcatttttaatactataaaattcatagatgacactgcattccagcctgagggacagagcaagaccctgtctctaagaaaaaaagaacaaatcaatagatactgataccaacattttagataatgaaattttcataatgtaattttaaatacactcacatcattacataaatcttcccagaaatattcctagtcatgttgagtttcatcaacttttccagtgttcaaatctagaaatccaatagactcttgaggataaatcaaaatgagggcagtgaaactggtatctgctcagcacctgttaactcaggaggactcaatacacccttgcacactgctgcttctctgaatggctcacaaggactccagctcactctccatcctcctcaaacatctggcccccacttgccctaagttgactctctgctcttagtctgtgctctgaagtcttcccagaggtgaaagtgagctgtcagatggaacttccctctcacctcagcgtggaatttactgctacatttaactatcactctttccataatggttgatttcttggtctgttcattacagatcaaaggcatctgatttgaatctttatttctttgcatttgtctccatgacaattttgggaggttttaccgccagcactatgacacgatgtagtaacatgacacatttgtggttaacaacacctacaaattcagaagctcttcggttgtcttcccagcaaatatagctgcttcttttctgtgtatgaacacatcctggaaacacgtacacacccacatagatatatacatgcctatgacattttcttctctgtaagtgaaaattaacctcaatttcatacgaagttcatcatttccctgaaggtgaaggtaggtcgtttttcatctgttctaacaaatgctcagacaccagctagtaagtgaggagctaccctgcttctggatgttggatctgtctcttcccctttgctttaccacagaagattggccacttgtccaggtcccaagaagagagtccaggtttgtcctgataatatgactcatccaacttctgataactctactgttacacacattcatggaggtagcctattaattacataattcactaaacaaataccaaatacccacattgcaataccccatacccaagggtatgttcatgcattcagtgaaggaaaaggcttttcagagacagatagatcaggctagattggtcaatatatgggtgaaaacactggacttgaatgtatctgttttcccccatgtcacatgtgagacctgtcagacaggaccagggttccttgtgcactcagaggtgagggctcacagaattcctctctggtttccaggaaaggtaactgcagtaatcttggtaatgagaatatcctccagtgctgacctattatagagtttacatatgaaattttcactgcaattcacaatctactctttcacacagaagtgtacagaggtcaggacacatcctcagggtcacacattgagaatgatgaagatatgtcccacgagtttttcctaaggtctcagaaagaattccaggactcaaaaggtctcagagggcagctcccagtgccttagttaaaatggtggctcaggcctgtaatcccagcattttgggaggccaaggcaggtggatcacctgaggtcgggacattgagactagcttggccaacatggtgaaaccttatctctactaaaaatataaaaattagacggggggggttgtgcatgcctgtactcccagctactcgggaggctgaggcaggagaatcacttgaacccaggaggcggaggttgcggtgagccgagatcaggacactgcactctagcctgggcaaaggagcaaaagttcatctaaaaaatttattttaatttaaaaatttttaaaaaatggcccactccctagaacagagagattccctctaaacatgatggaggtcccgaactatacattaagtgaatcctggtgtgtctgaactcacatgattattacgttaagctgctgttccaatctacttcctcacctgggaaaagaggagccagggcatggctagttgaggccccaggaagagaactgagttctcaaagggcaaagcaagcatcctcatcccagggtgagcctaaaagactggggcctccctcatcccttttcacctctttatacaaaggcaccacctacatgcaaatcctcactcaggcacccacaggaaaccaccacacatttccttaaattcagggtccagctcacatgggaaatactttctgagactcatggacctcctgcacaagaacatgaaacacctgtggttcttcctcctgctggtggcagctcccagatgtgagtgtctcaaggctgcagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagacacagtgaggggaggtgagtgtgagcccagacacaaacctccctgcagggaggcggaggggaccggcgcaggtgctgctcaagaccagcagggggcgcgcggggcccacagagcaagaggccgggtcaggagcaggtgcagggagggcggggcttcctcatcagctcagtgctctccctcctcgccaggacctcagctgtccccaggcctcctctttctttattatctgtggttctgcttcctcacatcctcgctgcaggcaagaaagaagggagaaatttctctgtttaccattaaggttttaacagtcactggcacctttttttcaacaaattcccacaaggcccattttaccttcttgacaaagtatttcaaggcttctcaccatctcttgattggcgtcatcggctgcatcgtgtcctgctcttaaattcatgtgatgaaaccccaatcccagtggctctgtatttggagagagggattttaagaaggcaaataagttaactgtggccataaatgtgggaccctaatccactaggactcttgtccttatgggaagtggaagacatcagaggcctctctctccacatgcacacagaggagaggccatgtggggacgcgctgcatgagaaggtggccctttgcaagcctggaagtggcctctcaaaaaactaaccctttcttcacccagatcttggacgtcaaggctccagaacaataagaaaattaatatttgttatttgaaacaacctagtctgtggtatcttctgatggaaagccaagcagattcacagatacaattgtgttagctccgtctcctggagggagaagcagcccaccgaggctgacacatctctcagattatttttataaagaaaaatagatccaagatgaaaaccccaccacatttctgctgagtcattcacttagcaggcttctctgagatcagccctggggggctgtgttctaggtcatgtctctcactttccactatgagaatccatgtagatcatgagaaccagccagatggagtcctgatcccggcccaccttctgctgctccccaagtatcccaaagaaaaccactccagcgtcacccctgtgtcttctactctctaaaatcccactaaagctgaccttaaaccaggagatatttggggccgggctcttgttctcttcttcttagtcttccataaggtccaggtgctgagtaaagcctcagtaaagattgagcttcagttcccctaacccacatcattcccttacatccttgtcatgcatctgtcctctgtgggcactcagggcaggttacacaggaattgcctgaagctggcctcaactgatgtgctgagaccacgggtcatgcacatgtatgattccgggtcatgcacatgtatgattccaggtcatgcaggctctactgcaggacagacctgtgtcctgtggggcacagacagctgctgaccccgggtctcctctaataactcacacacctggtgtttgtgtgtgtccagatggccccatgagcacagcacactagggtggccaaccttacaggtggggccgtcagatggaatggacaggctggtcactcccatcatcagtgatttcccagtgaattttaaataaattaaacaaaattaacaacaaaggggaaggatatgtacctgtctctgggaggtatacagggtcccagaactgtgctgggagtgggtgtgaaacgcccttttgtgtggaaagccctccagcatgagtgaaagctgaaggaatgatcactgtgcaggtggaggatgataggcagctggcagggtacatttcctgaagctgttcctgggtgcatgatggttggatggcccatggtgttgagggctggactcacataggaacaaggaaattatcccatgggaatggcagaaaagaaaatggagatggacacccctggagacagcttattagatttggtggaggaaaaatagaaatttattccaatgaccccagcattttcagctaaataagagttgcattaatagacagaattatgaaaggaagggagaaggagtttatggagggaaaaaaaaagaagataaattaaaatttaaaactatgcaaatctatcaattggcagataacagagtggagctgatgcagctacttccttgttctggaaacctgccagagacacttagcattcctgtaaggccagtctagtggtgatgaacttgtccactttttacttttttggggaacttctcaaacctcctgcattattgaagaaaagctttaatccatgtaacgtatttatttggaagtttcttggctttgtttttattttcagcaacttgaacagaatcatgcacatcatgatatttcggtgaacaacaggccacctacaggacaaaggtctcattagattataatactgtattttcaccgcatttttccatgcttagatatgttcatctgtataaacatctaccatggtgattcagctgcccacagtattcactacacttacatgacatacagatttgttacctaggagcactatgctatcccacgcagcctgggtgtagcaaggtatttcatgtaggtttgtgtaaacacactctatgatccttgcacaatgacaaattgcctaaggacacattgttcagatgtattcctactgtttttcatttttttttagatggagtctcactctgtcacccaggctggagtgcagtggcacaatcttggctcactgcaacctccgcctcccaggctcaagcgattctcctgcctcagccttccgagtagctgggattacaggcatgaaccaccacgcccagctaattctttttttctattttttagtagagatgggatttcaccatgttgccctggctggtcttgagctcgtgacctacatgatccacccactttgccctcccaaagtgctgggattacaagcgtgagccactgcgcctggccaatgtatccctactgttaagccacaaatcatcgtatctcatttctctcccttttttgtccctgttaatattttcatgttgtgcgtgcattcttctcctagctcagtgaacatatttataaggtttactttgaattttctgctaggtaatcaatgtatctccttttaatttgtgtcagtttctagtgctttttttgttaaataatttggaccacttttttctgttttgtgattattgttattattattattttttactttctctgttgctttctcctcattagaagaaaaagctaccgtaatcactcttcacagaatatgcccagggaaaatgccatcacctatcaacccaggctgtcattgtggcatctcttaaaacttcataatggttgaaattttttgttgttgttgttattagtggcactcagacctacagaggattttaagttttgctcctactctaaattaggtggcattgaaattcatcctgcaggcagtctctgataaagtggaggaattgggcagttttgttatgcatatggttcataaaaataatatgagtttaaggttttctcagccaagtgctatatcctgatattttataatcacttctttgaatctctcttgggtttatcttttgaaaatttagatcagaatataaaccaggtttgaggctttttgtttggtgtaaacatctcctataggtcattgcgtgaaaaggcacagagtctatctgaggaggagaactcagggaagcctcacaacaacaggggagacaaaaccgaggtcactaaaaaaatatgaagcttctggctcctgcagcctccagacatgccccacaccctctcattgcacagaaatgaattcctttctctttcctgagtgatctttgccaagattcctctcctccactttgacactttggtatatccatgtgtgtccattctggttcagccagggacacagaaccaggaagacatcgtggcttttctagagggagctggcttggggaatcaatggttggagtagaaagtgtctttgtccatgtgtcacagccctgagggacacgggaagaaggtcaggaagacaggatgaccagacggctggagcaaccagtatgaacaaagccactttctttcctggtgaagaggggcatttggaagcctggtgtccctgtaggggatgaaccacactcacctgcccactgttacttgccaacgaggtgacccgcagagcagcagatcctgagtcaccgacagtggctgcttcctcctccaaaccctccaagatctgtccttccaggagtgtgaacctcagcagatccgcacgttttcaatgggtccacttagctagtgtctgtcctcagccccatccctgggatcctgtcctggtgctgtgtacactgtcacaatagtggtgacagtgacagctggtgcctgcactttccaggccaagaagtttgaaagaagcaagtcacagggccagcctggatttggggcaaacacacaaatttcactctgtggggaagtgctgggaagcagccttgagtcctcctcagctcacgtgtggctgctgctgctcatcccaggtgggacacatgagccctccccatgcccaggatggagctgtttcagtcacagcaggatgggaatgtgtcttctctatgggggcttttgaagcacagctctcctgttcctgagatttgagatttataaagacaagtcccacagagtgaacctgcacaaataagacagtgcaggatccccaggagagacatcccatatgagaagggacaggcaggtcccatcactgacgctggtcctcagaaaccctgaccagctactgaccttcccaggtcccctgttcctggaacagttcgtgtgtctgctcctgaaaagatgcccatcaagagtccccagggttctgcccccttccttgatgtgcctctgggagtggggctggctgggctgtgggtctggcgtgaccctctccacaggtcagcggctcagtgcaggctgcaccgactcggtggggctgggctgtggctgaccctcccagggggagcctggactcttcttaggggtatctgcaggatcccaggttctgggagaacagggaagccacagtgtgtgcagggccccatctccagtaaagtgtttgctgtcgctctgttgacaagggcatatccccaggcctaggggcactgtgggcgcacgaccaatgcgcgagacacagggagtaaggcacagttccctcccattactgtgaggacactagacacagtgtgtgtgtgtgtgtgtgtgtgtgtgtgtgtgtgtgtgtgtgtgtgtccattactgtggggactctaaccaccgtgtgtgtgtgtgtgtgtgtgtgtgtgtgtgtgtgtgtattaggagttttgcagtggcctctgagacccatgatcttgcaggtttagaaattatctgatgagatgttcatccacaggaaccgacaagagattaggtgttctcccaaagcccctggaagctcctggactcactgtgagtgtggactgatccagtgcttccagagctccacagaaggggctccctggtggtttcatagaatccttgcttggggtgtttctgcagagttcactggctttcctacgaccaatttaccattgcaagcgatggcgtcagcagcacatggtgtcacgtgtcactaaaggagcattctgagccaggacacagccacttcatactggggggaaaatgctctgggagcccagacaggagcctctctgcagtgcaagggctgggctgcagggggcgctcaaggcccacccagcacaggctccagccccagagcaggtgcacaggaggctgcggatggagtccccttaagatctgtgtcattcttctaaaaaaatctaaaataagtatttgacaaaaactgctgaagagtccataaatatcctattcaactgcaagaatttatcaatttacactggagatttctaaccctgctacatatcttaatagtaagcatctggaggtcaattaagcttttattttatataaataagtgcaacttttggagaaacacactcatcccccaaataacacattcatgtattaaagcctagaaatattttaaattacctctgagctattcaagtgtgggttcccagtgaagtcctgttctagggaaaattgttctccagtgggagaagctctgtcaacatacagtttagggatatggcagggcacacatggcctctaaggggattatagcttgaacccttagcatcctcctgttgggtaatccatgtgtcatctctccactctttctcatgctgtgttaggtatgaaatagcatcgctcatgaatatgcaaataactgagatgactatagatatctttgtgccctgagagcatcacccaacaaccacatccctcctcagaagcccccagagcacaactcctcaccatggactggacctggaggatcctctttttggtggcagcagccacaggtaaggggctgccaaatcccagtgaggaggaagggatcgaagccagtcaagggggcttccatccactcctgtgtcttctctacaggtgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagacacagtgtgaaaacccacatcctgagagtgtcagaaaccccaggggggaagcagctgtgctggcatggaggaaatgacaaagattattagattgaagactttctcagaaaatgatattaagtcattaaggaaaaggaacaatataaacgtgtatttgagaaattttaattatttgagagatttttcatacaatatttattctgcaagcaaatttcagggattgaattaataaaactgatacagaacttcctctgtaggtatctgtgtaaacatcaatttctgaatcagtgttgtaaatattttggaacacacacacaaatcacattttatctctacttttatctctatttttaaaaatgccaaaaaaactcattttgtgcatgtagcattttgaattcccaccatcaatgcatgatagttcttggttttccacattcatattgccatttatcattatgagaattgtgtgttttaaccattctaataggtgagtaatggtatctaatttttagttaaatgcacatttccctaataaaaattcacatttaacaattttcatataatttttgccaagatgcctcttctcatatttggttcatttttaactgcattgttttcttttgattagttgtaagtttacttgcatattgattataaaatcatttaacaaattaaaagaattcatttaacaaatatgtgacttggaagtattttctccaagtctgcggctgtcttttactcccttatcagtatgtattgcagaaaagtgtgtgtgtgtgtgtgtgtgtgtgtttatacaaatttagatttaaaaaatgtaaaatgttattcatccacagatcatgtctttggtattatatctgaaatctcattataaaatacagtaatagcaattactttttccacgtctctaatctcaggctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagactaccacatatgttcttacatttactctttcctcagaaaacagacatttcctcatgtggactcttgtctcagacaagcaaacatgtctccatgtgaactcttcactcacataagtacacatatgtccacattgactgtttccttacacaagtacatatatccaatgtcgaattgttctgtggcaaaatgatctcaagataatgataatcataaaccccctccctgacaaggcatagatctgtatttttttcattgcaacctaactttgccttattgtcaagaacagtagtttgcagctctaaatataccaattagagacaggtgtccattttctctggaaacgtatttttatgttcttactggacatatttgttgataatgtttgctattatgaagataccccaacagtgtccacattagagaataaaaaatagtaatgggcagattaactctgtgcatccagacccagaaatcctttgaccttgacttccctgaaatgtagacacagaggatggatgagcaatgctgagcagtgcacccatgaccacaaaaagaaagacgtggaaatgtgtcccctccacttctcatgaaaggcagctcatcccctgttccctcaggccctggcgaggagccaccccatgtctgtgcccttcctcagtgtccacaccgtggggtctgcattgatctggattctcttctcatccccgtcaatattagtgtccttcgtaaatcaggtccagctgtggcttctcctcacggggctgttctcagtctgtttgctgtgttcacggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtgacacagtgagggaaaccctgtgtgagcccagacacaaagctcaccgcagggagacaggaggggactatgtggtagatgctgctcagaaccaccagggggcatcaggaccatcagggagggtgcacagaaccaccaggaggggctcaggacaccagggggcgctcagaaccaccagggggccctcaggacaccagagggtgctcagaaccaccaggaggcgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcgctcaggacactagggggcgctcagaaccaccaggaggcactcaggaccatcagggagggtgcacagaaccaccaggaggtgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggatgtgaccaagacaccaaggggcactcagaactgccagggggtgctcaggacaccagaggattctcagaaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactagtaggcactgaggaaccaccagggggcgctcaggacactagtaggcactgaggaaccaccagggggggctcaggacactagtaggcactgaggaaccaccagggggcgctcaggacactagtaggcactgaggaaccaccagggggggctcaggacaccagaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatatttaaaaagtaaatactggctgggcgcagtggctcacgcctgtaatctcagcactttgggagggtgaggtgggtggatcacctgaggtcgggaattcgagaccagcctgaccaacatggagaaaccccctctctactaaaaatacaaaattagctgggcgtggcggggaagctgaggcaggagaatcgcttgaacctgggaggcggaggttgcggtgagccgagaacacgccattgcactccagcctgggcgacaagaccaaaactctgtctcaaaaaaaaaaaaaagtaaataccattgtacacttaagtaatatatttggcaagaatggcatttacattcattcaaaaatgaaactgcaaatacgagttacattcaattaaataattaaaataatatagaaaaaaatgggtgtgttgttttggtgtttaatatacattcatttttgcatggacgggtatatgtgtcattgctgggctgttgtgtatgtgtgcgtgtgtgtgtgtgtctgtgtgtacaactatgaagtttaaaatatattattaaattacgtagttatattaatccaaatttatcatgttaaaatattaggaaaaaaacaccagtagagaaattacagagaacatcagcaatgcctacagcatttacaagagtcacattaataacaaacaaactagttcaaatgtttagatatgacacatgcagtagaaaacgttcacatggtattaacacaaaaatggtgcacaactgaggaaattataatacgttcatgatattggctacataaatgcttatgatagtaatgcttttcatccatcaaatgcttatgataatgcttttcatccatcatattatagatgataaaacaactctataaacacttccatcactagcgtttaatatgagatgcctcacatctttttctgaaataaataaacatctgtccaccacttcgatgatcatttcaggattatcctctgaaataattatccataataattttagtaacaatattattttcagaagcctattttataaggtctttgaactattatttttatgattgttactttatattttacacactttttatttggaataattataggttatcagaacaattgtaaggaaaatacagtgtgttcacatccatctccaagttttcactaaagttaatatgtcaaaaaaaacatgggacatgggactaatatatttacattgataagtttctgtttattcagctctgggatttatttgaattttgccaatttttaacagtttccttttttcctttttcttttctttttgagataaggtgtcactttcctattgctttttgtttgtttctttgttcaacccacgtaaccacatcaaattcagtcaccatgttcctctcatatcttctggttaatcacagtttgggttcctgctgtcttcccattgaatattctataaatgaaactagtcaaataagttgattctggtcacttatatatttacctattttatcacgtttgttttgtcaatcacagtaagtgtcgaattcgctatctgttatagatgttagcctattttctatcccagatccattggttaaatctttggtgatgccttttagaaaactgatccctttaccctatgtaatatgccccttgattcctgaaagtcttatgtctaccttgtctgaatttaacatagctaagcacgctttcttttcgttcatattttcatggtccatgttttcctgtatttaacttttctatgtagagcaaatttctgtacagagctagtagttgggtcttgctttttaaatcaactataataattctattttaaaactggtattactatttttctgttaatttctgttttaatttggcattttatgatcatgtttatttctctattaacttattgtttagttcatcttttatgaatattgtattggccctaagatatacaataagaattgtgtataatcagattctaattcaaataacgtaaaacctcttcataggttgtagagctattataacttattcttctaaacactctttctcatccgttgtcttagtttattctcagtttgcacttatatgtgctataaaatataatatgtgcatttttatcattacatagacatatattagaacaattaaaaatataaaaactacatttcaacttcattttttcattcttgaccacatgttttatttggatagattcatgtttcggatgtatatcatatggctactcaccctggcagaaaatttgccaaagcacctactgaaggatgaatgcactagcaataaattttctcagaatcgatttgtcttacagggtattcatttgactttcgctttaaatgaaatttttaatatatatagaattccagtttgactttaatttgtaatttattttcttgtactcatgtattcattattttcttcctgaagatggtcacacattccattctgctgggccttcattatagatatttgtgtgtatctattcagggctatatttgcaatttatggatgccacaattatcagagttgaagtcagcttctgctgtccacagagatttcaagttcctcccatgatacttgcttttgtgtccctgtttgatcctgggtctttatatttagttttccccagggaggctgtctgtttcagctgtggaaagtgcaccctactgacagtttaaattgatgactgtgtggtgaaggaggttggacaaagcgggacttcctccaaccttctgactgagtctccttcttatgcaggagtagtaagcatagttctggggagtggccttccacattgtcctgtccttaactctttccccagggctggaacgtcttttcccagacacaactgtttttcaccagtgtccccagctttttacccactatccttaccctaaagagtaaggatttctttcctgaggaaggagatgggaggtgtttctggatcaagtttccttggtgtcgtctgtttccttttgtttctgttgacttcaccacagctcatatgacacatgctttggtggatttcccctggaggtagtggaggtgcattcaggcattccacaggagctgctgttcttttccccagtcaacaccacaagacaccagatgaggaagttgtccgtggatttttcaagttctctaggaaaagcttgcaagcactaggccaatctaacaccattagtacatgcatactaaaaaaaaaaaagtcattaagtatttctaggttagtctgtttctatctcaaatgccatccagtggcacctgccctacgtacactagcaggtaggtcctggttctctctgcaggctcctatcttctcagatttcagttttcttgtttgcttggtgaaatcaactcagatatgttgaatgttttttctctcttttatttgtagctgttcagcttcgttgttaatgaggtcagaataaaatcacagttttctcatttttttcacattcccacactgaatagctgctttccgtataaaagccagaaactgagagaacacattgaatatccattacaggtgaatgttaaacaatttgagatatgtttgtgtactggaataaaatgctgcattacaatcaagtcatcactcattcacataaaacatggccacattctcaaataatgtagggacctgagtgcccctccatctactggcctctcctggggccctagcctggccacaccttcttgcagggcagtcttggacgccctgggatcccgcaccaaaatttctgccctggcagaacatgcctgactggtggagagctccaatcgggcagccctcatgtgcacacaccagcttacacacttcctccgaatactgtaggttcacccaggcccacgtaacttcccacatcactttgcagtcacatgtctgtataggtgggttttgcttttcttgtcccaccattgcgtggagtgcagtcccctccccccaccccaaccaccatggcagaggaagctttggtggggaaaaagccagggccgctcctgtcagcgtcccgcacttgcgctaattctgcacagagaatagcagatcatctcacacattcagaaatcactcctgcttgtggggcatgaatacggcacccgggcctgtgcccacaagtgtcccatccctgagccaacacctcctccagtgtgaccttgaacacagtcaccaacagggccccacagacgcaatgcctctgccactgtggcgaacacctgcagggaggcaggcacccagacacccactagcactctgccacagctgccacacctccaacagcccaggacagtggattcctaaccttaaggagccggagaaccaagtcagggactagtataacttcccccagagtcagagcacacagtctaggtgttgggagctgagcactggccacctaaatttttccagaaatgaagccagttggctgaatccaccttataccacaatcaaaccctcaaggtcatccaatagggtaaaagaaaataaaaatgtatccaaaggtcagcaacttcaaagattgaaggtggataagcccacaaagatgagaaagaaccagtgcaaaagtcctgaaaacaaaaagggcgccctctttcctccaaacaaccacagcacctcttcaacagcagttctgaatggggctgagatggctgaaatgacagaaacagaactcagaatatggagagtgaaaatgtagatgaatacagctatttatggagaatactataaatgttcctcaaaaaataaagaaacaaaatctactgtagaatccagcagtctcactgctggctatgtatccaaaggaaatgaaatcaacatgtcaaagagatatctgcactccatgttcacgttcattgcagcattatttaaaatagtaaagatatggaaacatcctaaattcccatgaatggatgaatgaataaagaaaatgcatacagacacaacagagtaatgttcatccttaaataagaaggaaaccctgcctctgtgacagcatgcatgaatctagaggaccttatgccaagtgaaacaagccaggaacagaggaagagtcattcatgatttcactgtatatattaaagcagtagacttgcagaggtagagtagaatgttggttaccagggcctagaggggtggactgggaaagggagatgtgggttaaagtgcacaacgttccagttagaccggaggtataagttatgcctttctaatgcacagcatgtcaactatagctgataaggtagtatatatttcaaaattactaaaaaaataaacattagaatttccccactaagaaatgataaatttgtgaggtgatgaatataagcggcttgagttacccagttcataatgtatacatgtatcataactaaacaacatatgtcataaatatatgcaaaaattatttgtaatttataataaaataagtttcatatttaaataattacattaagaaaatgaacagaaactttcagatttcaagaatattttatatatatatatatatatcttaaaacaaacttgcaacagaatatagaaataagttttacgactcaatggaaaagaacagaattcaataaaaactggctaaaagaaacaacagctgcatcattatagaaaattctggaataatcagccatataaagattctcactctcttagaactagaattccgtaggacttgtaattcctcctgacctgggtgggaggcaaaaggaagaacagctaatggtgattcagtgagttttatacctgtgtgtacttctgtgctcactcagcagaaagaaaagaagaaaagaaagaaagagagaaagaaagaaacagaaagaaagaaagaaagaagaaagaaagaaagaaagaaagaaagaaagaaagaaagaaagaaagaaagagaaagaaagaagaaggaagaaggaaggaaagaaaagaaagaaagaaagagagagagggagagagggaaggaagggacagcagaagtcattgtggtgtgtgtgaaagcacaatccttgggctcccccacatccatctctactccagtcccatcaatgtccagcaaatacattttctaagatgaagtattttaaactttctaaatcctgctagaaaacccctcagctctttcagttttgctctatcacttgaattattgaattaaatctagtttttgtgggcctatcaataccataagccaaaataacacatgaagaaattgcactgagacacatgaaaaccttctgaaagctccataatttcagatctgcattcttatttccccgaacctaaatcactgaatagagactcagaacgagttgatcttgttcctgaacgtgcacagagccaaggacatcctgtctgtctggaacagctcaggtttgttcctgtttctcctagaggatataaaatcttgagttagggaaaaacagccagggacaccctgggctttgttcttctctcccctggaggcaggatgtccttcagagctttgtcccagtgggtaacacagctgctgaggtgtacaacccacgtggcctcgttttggtcacttttgcatggtgagcctgctttgcaccatggcctacaatatgcgtgtgtaactaatctgtctccatcttcaaaatgacattattccacatcaaatctagtgcaggtgcctcacacagaacattctcaattacctccatcattcataaaattgatgccattaatttcaagtatacatacatcagactcatttaacgtattgttattctcattgtttgaaacataacttttagatcaaataattaacaataataaaaatataaattttgaagtcaggtaatgtgatttctctagttgtgttctctttgctcagaatggcttgggctgttctgcatcttttgtttttccacatatattttaggattttttaaaaatttctgtgaagaatatcattgttgttttcatagggattgtactgagtctgtagattgctttaagtattatggacattttaacaatattgaatctttgaattcataaacatggaatattgttccatcttgtgtcctctttatttcctcaatgttttatagatttattgtagtttttttttactttgttcattacacattgtatgcctgtaccaaaacatcacatatacccaacaaatagaaatatatatactattatgtgcttataacaattaaaaattatgtatgtatattgaatctattcaaaatcagaaactatttctttttactgtttgtaaggtcttgtctctaggctataaaaagaatttgtaaaactcaacagaaagcataatataaacagaattctaaaatgagtgaaaatctgaacaaacacctcaccaagaaaaaatgttatctgaaaataagaatatataaaattgttcagtatcaattgtcataaactgatactcatatttaccaaatacaaaagtaaacatgatgtatttcaacagaattgattctcaaatatttgtatactcatacagtggaatactatcagtcataaaaactatgggttattaattcagaagacaacattttaacattttttctaagtgaaggaagatggacaaaagagactaagtattgtacaattccattcatgagacctgctaaatacagtaaaattaaaaggattttaaaaacaggtttgtgataggcagggcttttggggaaagacaagagactgacttggcaaagctcaggggatatttttagggtaaaacaaactgtgtgccattgtgatatgcctaatttcttattatatttgttcagagttaatagtgtacgtttcaaccaactcggtgattttatattttctatttgctgatagagacatgttcatttttgtcaatcactttgctaaatgtggctgagaggctgttgaaatgaacgctgagcaaatgtattcaccaaatctacaagagcaaattatttgccaattgctgattgagtggggtctataatgtatttgagattgggtgtggggatgttattgtgtgagatcatgatgtttagaccatgacactctctggtgagggatcactcattcattgcacatttaatgaaaggcaggtaggaggagcagaaggggatgagtcacactcctgaccacagccacaggttattgaaggcagaactgatgtaatcccctaaggtagaccactgcccctccaaggtgaccttatcctagagttgacacacatcctgggacaccagagacaactccttctctcccctttctctgcacttcagctggaagcaactgtctcaccgagcaccttgtgttaaggaatgagagttcctgttccaggtgtgagggcccaggtgcatccacttgatccagcacaagagcaagaacagccttccagaaaatgacatcgcctgaggtataaccagctctcacctgctgcagcttcctctgaataaaaaggaaactgttgaaacttcctcataagtgtcctgctgtgccattccctttgtccccacatgttcagttgtgtctgtccagatgtcacttttgtgtagggagattagggttctgcttccagtaccagaacacacatgacctcttaggggacttcagggttttgctgacatatgtgatgatcttaaaagtcattagctccatttctacatcaaaaaacatctgaaccaaaggagcacataggctcaggcctgtaatcccagcactttgggaagccaaggcagaggaatcacttgaggtcaggaatttgagaccagcctggtgaacatggtgaaaccccgtctctactaaaaaatatatacaaaaattagccaggcgtggtggcactagcctgtaatcccagctacttgaaaggctgaggcaggagaattgcttgaacccaggaggtggagattgaagtgagctgagatcgcaccacttcactccagcctgggcgacagagtgagcctccatctaaaaaaaaaaaaaatttatatatatatatatatatatatatatataataaatatatattatatatcatatatatattttatataatatatatgtatatttttatatattatacatacatatcaatatatgatatataatatgtatatataatatataatatgtatattcatatattatataatatgtatattgatatatattacacatatatattttgatatatatatatctccaaaccatctaaatatcaagtattttttaatccatctaagagctgaaattgctgaaaaaactactccctccaaaagctgtagagacaggcacatccacagtcacagcagagacttgctgacttggaagagaagctcctggagacacattggtgagaacatttacctggtgattatgctgaatgtctggaggacaaatgtggactagggggagggtgagcactcctagaggctgtacaccccacacttgtgtggacttgccctccagggccttcaggttctcgtggaagcaattaaaatagattccctatagccatgaactggggaggagtaatcacggagaaaagatgcacaaaaagacttttctagaaagctcatccaagggaaggtattctccaaaatcttagtttatgtgggggaaggaaatacttccaaattacagacccctcctcctcagccttcctctatcacgcaaatgataaaattagccaagaggagtcagattcaaggcggtagccctgggtgcagcatctgcagaagggaggaaagagagaaaatcagctgtatcactggagattccttgtgaaggtcactgctcaggagaagagggcaaccaaaccagggagagtcaactgtaagaacataccatgctcccctgccccacacattacctcctcaacagcatcattaatatggattaaagagggcagtgtgattgctttagatctgtttgagaaagaaagtcacatactgaggcctagggtcagggtcggcggcacttcccgtgagtaagatactacgaagaaggaaaaattaggggtccataactgtgaaaatcagccacagtgtgtgtgagaatgtttgtgtttgtgtttctgtgtgtttgagtaggagttattggaacagcggacgtggagtgagctttaatccacatccatctgcagcttcaggtattctcagatgcagtattcatctgcaagagccgaaatgagaaaagagccacctccaacccccccagagttttagcctccctttgtttccagtgatccagtgcatctagacctccaggaagtggactccctggtgattttagcgattcttctcttggagccaccctgaagaggacattgggtttccaaaggcccattcactatttcaagaagtggtgccatcagctcatgttgtcactgaaggagcattctgagccagggcacagtcacttcctagtgagctacagaggctgagagaaaaatgctctgtgagacccaatgggaagctccctgcagtgcaaggtctgggtggcagggagcgctagggcctcgcccagcacaggctgcagccctggagcaggtgcaagggaggctggggaggggttcctcccagggtctgatgtcttccttttctcggacaaacatgctttaataagttaaacaagactttagtaaagactattgatgtgtctttgtgtctttcagtatacagttctatttgtaggatttatctaacctaacaagtcaatgagaatcacatgtaaaaggagaaatttctaggattttcagatatcttaataggtaggagatggagaaaagggatggttttattaattcagtgcttgccaatcttaacagagacagtagtaagacatgcagaaagcaaagcccagaaaagtatgaaggtgtcaaagtgccatttaagtatgggttcacttggaggaccatgttctgcgggaacttgttttcagcagacaatctattttagcagagttctgggcatacaaggggacacacatcattaaacaaggattgggacagggacttcagcgtcccactgttgcatggcccataaattatgtgtgttctctttctcatcttggatcaagtctagagctatgaaatagtatccctcatgaatatgcaaataacctgagatttactgaagtaaatacagatctgtcctgtgccctgagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacacagtgtgaaaacccacatcctgagggtgtcagaaacccaagggaggaggcagctgtgctggggctgagaaatgaaagggattattatttttaatgttgtttacagtatgtcattaataaattgaaaaaaagtaacaatagaagtatatactctaattatatgggaactttgttttttcagttttttcatttttttttttttttttggtttgtttgtgacagagtctcactctgccacccaggctggagtgtaacggcacaatctcagctcactacaacctccacctcccaggttcaagcaattctcctgcctcggcctccagagtagttgggattacaggcacccgccaccatgcccggtgaatttttgtatttttagtagagacggggtttcaccatgttagctaggctggtctcaaactgctgatctcaggtgatctaccctcctcagcctcccaaagtcctgggattacaggcgtgagccactgcgcctggcccaattatatgggaattgtttatataattatcaccctataagcaaaattcatggaggaggaaaagctctactgaagaaagctgataccggcattcccatgaaagtatctgtgtagaagtaagtattaaaatcagttgaataggcaaggcatggtggctcacgcctataatcccagcactttgggagaccgaggcaggtggatcacaaggtaaggagttcaagatcagcctgcccaagatggtgaaaccccttctctactaaaaatacaaagaattagctgggcgtggtggtgggtgcctgtaatcgcagctattcgggaggctgaggcagagaattgcttgaacctgggaggtgaaggttgcagtgagccgagatcacgccactgcactccagcctgggcgacagagtgaaactccatctcaaaacaaaacaaaacaaaacaaaacaaaaaaacagttgaataaagtaccttagagtcatctgttcaattaacatgtttaactccaaagaaatactgaaaatattttccaaaaaggaagtgccattttacgttcctaccaacagtgaataagattttcttttctggagccttgtcagtattcactaatgctttgctgtgcagccgttgtaatattatagtaaatgagtagcagtatttaatggttgttttaaatatacatattcttaatacaaagtcttgatgaacacttttttatacattgttttatgaggtgtgtgttcagatctatgtatgccagaaatgcctggcagcgttaatttaagcacactgtgagaatgaccctatagtttatgaagaatgtatgttcagagctctgagctaagaaatccaggagctgtcaacccagaagtttattccttgtctgtgaaggacatctgaatccctggcctatcccttggaacacaggatgtccaggtgattgatgctctttgttaaatctggaggttgctaggtagagggtgctaagtgaaaatcataatataaactacacgtgttttacaaatggtagtggttttcctgtccaacacacttttcctgggccacattgtatgcaagtcctcaatacaccctaggtcttgttcatgggctccaggtctcctcttcagccttttggacatggtgccatgcctattacagtcaataggggtctagcatgacaactggtaggcccagaacaaggtcaaagaaaatcctgcaagctcttagacaacagtgtcaaggaaggggagacctgtggggaaatcccaggcaggccatgcacatctctgtgggcccaacagctgcaatccttgatggatggggcccgctgcatgtgtacggggatgcctccaaaatgccaaaagttctggaggacctgttgcctgaggtggatgtgacaatgtgacaaagtgacagtcagattcctgagctgtggcagctgttggccactcctgactgcactctgagcaaccactgaggcagagctcattgcacaggctagggtgtgtcagccacgagaacagttgtaactataatgagatgccgcctgtagggataggatagcaaattggagaccattgtttatttggtaggccatttaaagtgttgctgactgccacaccaatgcattaggactactatgactacgtcatcctgggagcctaagtcctggcgtccgatgtagagctccagtgggaaggagatgaaggttaggatgagtccataaaggttcttgctctgcagcccctgctttgctgtctcacttggtgaacagagaatgggaggtcaatgcggacaaagtccagggtccaggcttatcagtcaaatacttggtgtcatctggttacataagactatagttattccatatttcatcatagataagataagatgcaggtctactcatgtcccaccacaccaaagcagttggaaacctcccaaggcctcctgggacattggcgatcctttattccccatttcggcaaaccccttgggcccccatggcacttagacaagaaggtgccccactgcgactgttccaaaagggaggatgagggctctgaagaagctgaagtcacagtgaaatgaatacaaaccttgggagttctagtgcagggacagccctgtgaattggatgtagtcagttaccctgaggggtttaggtggggactgtgttaaaggcaaggacataagtgtgtgtccctaagaccctggtctcaaagacagaaggaagctgaagtgagatatactgtttaggagtagcaactgcactacatgtcatgccttacgagtgtaggatgtgacaaagagggccactccacatccggaacaacctttagcaggctggctaaaggatgccttccagacacaaaagccttggaatgccaggacacagtctgtagccaaatggtacttgtggtggtcaccaccaacataaaagtgggccaactgtgccagcagaagttagccccacagaactttcccccacctaagagaaggcagtgcaccacaatgcggaattccaccactgtggaattgggggagcttagaattggattcagacacaaggggagagagtggatcacagggtggcttctctatgggatagggggtggagagtattatactctctggactcaagatgagtaaaatgacacccatcacaaaccatccagccctatgatggcacctttatggtaagtggttgcaggctccaagggggccgggtccaatgaggaagatgcccccacagctcgttctcaatggcagactatagaagagttgcaggatatcttctgggagtcgagatgaggcatgctaattatgctgagaattattgaagtcccaacaatgaattgtttactgcaaaataaaagctacagttatgtattcagtgcctacccaatggcatggtgcactgatttccacgttaagccccctgggagggcagccaacatttcatgtgccccaggtagttgctgacttaggagaaaagaagaaactgagtaagcaagggatgcaccctactgtgatgaagaacaatggcaccaaaggaagagagacagccaaggagccagtcagggtggccagacaacgaatgtgctctaactggcaacacctaccagttctctgggcccatagcggcaataggtggttatggaagggccacggaagtcagaccggttgaactagtgatacgacctgggggactgccacccagaccctgtgtagtatacacagcttccatcctagaacacatgagaatggatatcttcttaggcgtgaccctccaaacaacggccagggaattccaacggagagttagagtggtgatatgtgtgaccaagcagaaggcaaactggatgccagtagagctgccaacccatggggagtcccacagctggagcaacaccacccgccctgggaggggaagatgatccaatcatgaagattgttaaggagctagcccaggtaggcattaggaggccactgcatggttcctacaacagacctgcatggcccatgcagaggccagttgagacatggagaatgacagtagattactgggagttaaataaggtggtctcccgagtgaatgcagctgttcctaatatctcctccagtctgacgagaataggagaggtgttagccacgtagcatttccttatcagtttagtcaataccttcttcagcatttctgttgccccagagtcaagatcaatttgcattaacctaaaaagaacaatggacttttactgtcttgttccagggatatttacacagcccaaatctcacagcctagtgacctccaacctcagtcgatgggctgacccaaaggggatacatgttttccactacattggtgttatcatgataacctctgagtcttttttcagcttataaattacagcccctgtcttgctgtctcacttgctgaatagaggatgggaggttaatacagacaaaatccagggtccaggcttatcagtcaaatagttggtgtcatctggttgggtaaaactaaagtcattccatctgccatcatagataaggtgcaggcctacccacgtcccaccacaacaaagcagctgcaaactctcaaggccttctggagcatcagtgtccttttattccttttatttgacatccctgaaggaggctgctaggggagactgtgtccctcctaaattcatgtgctgaagtcccaacccttggtccttcagaatgaaatcatacttggattagtgtcctttaaagaggtgaataagttaaagtgagattcctggagtggggccctaatgcaatctgactgttgttataagaagaggaagcaggagggagggtgcacaggccccgagggacggccatgttaccacagaacagtgagaaggcgccatctgcatgccagggagcgagacctcagaggaaacccacccagctggcagcttgatcttaggctttcatcctccataagtgtgaggaaattggttttgtattgtaagccatccgatctgtggtatttcgttataaaagccctataaaatgaatacagtaggtaataggagagcttctatacattgaaaaagtcggatggccagaaaaacctagacactcctgttcagacctgagcagggtgatggacctgctttgggacaggagaggggaagagatgaacccagcacccagacccagctgagcccattcctcagcaggccgtccctgggccggagcttgcacaggtgtgaaagagcctgtcttggtcttcaggggctcatggagttggacggagaatggtgtagactcaagaacacgtcatcggtgtgcccgtgtttatctgaatgggatgtgtttctagggtgtgctcatccccaaagaagaattaatcaggtctcttgggctaaaaagaggttgtggcatttgtgtgtattaataactgtggtcggacagtaaattatgttaaactgcttatgggaaggcacaatggaaagaaacactttgttacagaaggaaaaaaaaggtgattatttaaatgaggtgcctttgaaggtcaccatgccaagaggagcccatcacatgatagtgctggctttcatgttcaggagatcaggagggtccgtccgctggcttttatgacaccctagacagagctgagagtgtaatgtatgaatggaggggaagtggagagaggggaggccaaatgtttggtgggaatggagggtcactattggagccattaggaaatacacaagcatgaattatgctggaggacagaacagtgttcctggggaatattgtgttgctttgggagctgctgaacatacaggagtttcactgttcctagttctcaaattctctagactctctggacaacccagttttaaatattgggaatataggtaagacacattcgttattaaaaattattaagagaagatgtaggaagaaatttaaagtaatccatttggttatgaaaatttagttacagcgaactgtgatgtccgtttcttacttggaataatggaatgtaagtcattagtcatctcaacggttcatttttccataaccatcaattacaaaactgctgagtaatttcctgaattgcccaccatagaaactgacctcacatttcctcaatgagaaactgccagtcccgttgatccagcctcgttcttcccatcagggattttgtatctctgtggacgtgtggcacagtgctgcatatccatcggcatatggcctcaggaaaggcgccagcctatccatgcatgatgaagcttacttaggggatgaagcccgcatgctgggtgagccagtgccaacagctgaaagaatcaactgcctggtgtatgatgcttttatgaaaacaagcccagggcctcttgcattcttctgtattagattctctggtgaagatttttattcatttctgcctgaaattgccacatataattacctggaagcattacaataaactgatttggaagttaactgacttcctggtgaggttaaaatgagtgtcaggtgcatagtgagacagaccggagacatggatgcatagcaaacttgtgctcaccatggtttctatcttagttagggaaacttctgtaccttccttagatgttcaggcactccattgaggaccctggcataacattatttattgacagaccatagctcaaagtatagaactggatactaccaaggaggatatactattactattttatctttatcttaaaatatactcttccatctgaggtgaaaattaatccagatggtagaacttattgcagttactacagcattttagcaaatcaaaagccgcagaacaaacatatggacagatggcaggtatgttttcggaatcgtaaacaagttcgtgatgactgtaaaaccaaggggtgtctcacgagggctggaaacctctcacaatgaaacaacacaatgaggatctttgaaaagtactctgacctcctggtgagctggctgatatggaggctgagctccatgtagaaagccaaaggaatttctgcaggacgtcatcatgccaagcacagccgtaacctgggtcccagcccttttcacacgctcaatggttagatcttgggagggaatcaaagaagccatagtaaaatatcaaaatttaaaccccgattttgaatttaaaaagtgttaaaatatggttgtggcctacactcagaaaatctgtgtccttcagatggtttctcagtggcaccagatggtttcaagtggctattcattaagtttctcagtgaaattaccagacatagaataaataaattgtcactgtcttaaatcaacccatgggaaaggaaaactgtgtaaatacagcagagaggaaacattgctcaagggaaaaacaatctccagaaagtattgttaaagaaacagaggccctctttccagccagcgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgttcccaaaaaaaaaaaagaaagaaaaagaaacagaggcatcacacttactagaaaaacatattctatttcatatattatggggatatgacgtgatgttttgacatatgcgggcattgtgaaattattaaatcaagtaaataaacatgtccatcacctcacatacttattttttatggtgtaaacgtgtaaaatctactctcttatcagttttcaagtatatagtacattagtatcatggaagtcaccatgctgtgcaatagatcttcaaacgaattccttctatctaaccaaaactctgtaccctttcaccaacgtctcagctttcacatgcccctgacgccagcccctggtaggcaccattctactctctactctgagttcaacatttttagattgcatgtgtaagtgagatcatggagtaattttttatacctggcttatttcactcaacataaagagtcaaatgctcaacatcactaatcatcagggaaatgcaaattaaaaccacgataagatatcacctcacacatgttacaatggcttagtctcagtctgtctttttgttactataaccgaataccagagactgggcaatttctaaagaaaaggaatttatgctttatggtgcttgagtcagagaagtctaatatcaaggcactggcatctcacaagggccttctcactgcctcatctcacagcagaggtgggtgagcaagagaccatttgtccacgagagaaaagagaccatcttttattagaaattcactcctataataactaacccactccattgatagtgacagtaatccattcatgaggacagagccttcatgacttgatcacataataaaggtcccacctctcaacactgttgcattaaagattatttccagatcctaaactttgggagacacatttaaaccatagcattccattcctaatatcaaaatttatgtccttatcacaatgcaaattacattcattccatcccaattgtctccaaagtcttatccagcatcagtgcaaaagtctgaagtccaaagtctcatctaaatcagatatgagtgtgactcgaggcacaatttagcctgatataaattgtttccatctgcgagcctataaagtcaaaacaagttatctactttcaaatacagtgaacaatggggcaggtatgggatagaaattcccattccaaagctcagagagaggcaaggagaaagcggtgcctagttcaaaacccaacagggaaaaaaacattaagtcttatagctggaaaatcatcctctttaacggcatcttgtgcacactggggagggggatgggcccccaaggcctccggcagtcttgcctctatatattttctgggttcagtccactcagccgctctcacaggtgggactctcaggcctctagctctcctaggctgactggaaactctttgtggtacctccaaacccacatttctgcttggcattgtgctaagggcccagtgtggtgactctgtctctgcaacaagtcactgcccgagaccttaggctgtccttaggctgcccgagaccttaggccgtccacagcattctttgaaatctaggtggagaaagccatgccctcgtggttcttgtattctgcacacctgcagaattaacaacacatggatgccatggaagttgatgacttgtaccattaaagtgatggcttgagccacacctaggtcctcctgagccacagcatgggcagccaaggagtgctgtgcctggacaccgggaacagagtcctaaagtgcctgctagaagtcaggccatagatttccttcaaatttctcccaccatataacctcgttcatggctctgaacttccaccttacagaaggacctagggatgaacacaattcagccacgttctttgccactttatggcaaggatggcctttgctccattttccgatgagctattcttctttttctcctgagacctcatcagaacggcctttattgtccacggttctactgacattctaatggtcatcacctaaataatctctaagaagtttcagaatttcctcacagctctcttcttctgagtcctcaaaagaatcacctctagtgttctattcagggcaatccagactttttatagtctgatcctccaaattattccagtctttgtgcattactacatccacttctacattttggggtatttgttatcgcaacagccccacctcttgatactgatttttcgtcttagtccactttgtggtgcaatgagtgaataccacacactggctaaagtataaggaaaagaaatttattttctcgcagctctagaggctgggaagtcaatatcaaggtgttagcatctggcaagagccttcttgctgtgatgtccatgtggaaggcaggagagcaggtgcgaaggatggaaaggggtttaaactcattttttaatgaggaacccaggcctgtagtaactaatctgctaccacaatgagtaacctactctgacgataatggcattcattgcttcatgagggcagagccctcatgacctaatcatttcttaacattcccacctctggacactatggaatttgggattaagtttccaatacacatcctttctaaacagcaggggctttttaataggttgaccacccaaggctgcaggaggctctgaagcagtggcctgaggttggctgtcctttgtgagaatggagagaagtgaactgactcatggagacacaagtagatgaggtaaaggcattcattgcttcattacatggatggtgaggtcgattgaaggcattaacggattaaagatggtggcaaaaccgtctgaggtggagaccacggggagtccatcagaaatggaggacacgtcccaataaatggtgcttcatttccctgcaaagcagaagaaagcaaagaacaaaacacaacatcatagtgtacactgagcagtggattgagagaagagtttcctaaggcataactgacagagtggagaagacacacaaatctttgcatgatgctaacatttggactgtggcttcattatttcttattaatattttactgaaatatcgctagaaggagactgaaaatgaagtgtgaaaagttaaatgggatttctgctctatgtccttttcagatgagaggaactagggaattccagggaagaaacaataatagctgctgagcaaggcttttgcagggcaggacaaggaatccccaaagagaaaacggaaacctcagcttcactttgcatctgctcctgagccaggtcctgagcgacccctgtaggtcctgagtgcccctccgtaggttctgagcatcccttggttgctgggcgccctctggtggtgtctgagcccctctggtggtttctgagccccccgccttatgtctgatcctccctggtggtgtccgagtgcccctgctagtgtctgagccccctggtggtgtctgagtccccttcttagtgtctgagccaccctattagtgtctgaggacccctgatggtgtctgagcccccagttagtgtctgagccaccctattagtgtctgagcccccctggtggtgtctgagcacaggagagctcctctgaaggaagggtctacatggggacaggcgtgcttgtctcagggaagggtccatgtggggacaggtgtgcttgtctgaaggaaggttccacatggagacaggtgtgcttgtctcagggaagggtccacatggggacaggtgagcctgtctgaggggacagaagtgcttgtctcaaggaagggtcctcatgtggacaggtgagctcttttgagggaagggttgacctggggacaggcatgcttgtctgaggtaagggtcctcctggggacaggtgtgcttctctcagggaagggtccacgtggggacagaggtgcttgtctaaggcaagaatccaagtagggacaggtgagctcgtctcagggaagggtccaggtggggacagttgtgctcatctgagagaagcgttgaagtggggacaggtgtgcttgtctcaaggaagggtccatgtggggacaggtgtgctagtatcaagaaagggtccacatagggacaggtgtgcttctctcagggaagggtgcatgtggggacaggtgtgcacatcggagagaatggtccacctggggacaggtgttcttgcctcagggaagagtccaccttctcagggaagaagtgtgctcctctgagggaagggtgcacatggggacaggtgtgcttgtctcagggaagggtccatgtgggaacaggtgagctcatctgagggaagagtccacgtggggacaggtgagctcatctgagggaagggtccacatggggacaagtgacctcgtctgagggaagggtccacgtggggacaggtgagctcgtctgaaggaagggtccacttggggaccggtgtgctcctctgagggaagggtccacgtggggacaggtgtgctcctctggagggaagggtccacgtggggacaggtgagttcatctgaaggaagggtccacatggggacagttatgctcctctgagggaagggtccatgtggggacaggtgtgcttgtctcagggaaaggtccacgtggggacaggtgtgctcaccttggggaagaggacagatgagctcatctcagggaaggggccatgtggggacaggaccaagggttgggacttcagcacaagaatttaggaggaacacagtcttccctagcagcctccttcagggatgtcaaatattttccttctgttccctgtgaaagccttaaaggggtagggaaagggcgttcaacctgcacactcgtagaggggaaaccagcttcattagtaatcgttcatctgtggtaaaaaggcaggatttgaagcgatggaagatgggagtacggggcgttggaagacaaagtgccacacagcgcagccttcgaaacacaccacggtcacgttaagtttaaatggagtgaccacattcgccaggaaagggaaatatttacacttttgaagaaacagtaatttgtgtttctgattatgatctggccttggattttccctcccctcataagcaatgacagaattggcagaaatatgtgaaacgttagttctcagacatgagacacccacagagggccccctgtgcccttccctgagagctgatcagctcctgcatctgaagaaatgaccaaagaccaggagagaaccacacagaagcatcggagggacagcacctggggctctgatggggtcaggaatagcatctgttcccaatagatggactaagtaaaaagtatcataattcacaagagttttacatagcacagaagaaaaagttaccctatatcaactgttgatcttgtgaatccaggaactctggattcaaggtggtcgggcacatcttgatttacgcatttcagggacacatgagacatcagtcaatataagtaagaaggacattagttccatccagaaaggctgagacaactcaaagcaagtcctccccacttagggcttccaggtcacaggtaggtgagagacagatggttgcattcttttgagtttctgataagtgtttgcaaaggaggccatgaggatatgcacctgtctctgtgagcagagggacaactttaaatagactgggaggcagatttgtcctgagtggtttccagcttgacggggcccaagatattttcctttcacaatctggtaacttcaaacaaaacttcaaagccacaacaaaacaacacaacaacaaaaagaataagacatgggtacttattaagagtagaaaaacattcagtccccaaggaaaatattggcagtgtctacctccacatgacaaaggagtaagcagtgtgagccacagaaaggagcactattaacccacagagcaaccgagaataacacgggtgatgcgagggcattggacgcacatcattgcattttgtagattcagaaagaaacggaaaagattgacggtggtaaaagagacagccctgcttccctctcccttttccctccccgatgaggcctcacagccatgaccctcagcctcatcccgcagtgcagcagctgccgtcctgtccaggcccaccccctgccccgccctgggactgttacctcattccctcccggagtccaggtgccccccggggtgtggtgcgggagcctggggaggccctttgttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgcccgtgcaagaccaccacgcttggcacggccccacctcgtgtcagggcctgtgtcccctgccccaccccctaaacagatgggaaccactgggactctgctcagggcagggggcggaggtatgtgtgaaaggaaggcaaatgtgcactctgttggagaaatattataggtagtttgagcaaaaaatctaatgccatgggaacttttagaatgatacgtattttaacaaagaacatgaccaatagagtttgtattgaagccaggaaaacactatttagagcaacagcaatatcaaaaacacaagccaacagttcaccaagaaaaaccaccattaaccccatggaaatggtcttccaagagcatcggcacttaaatcctggaaatctgcctgcctcagcacctgttgtcctgacctgccctcctgtgtgtcctaatcactcccaaacacggggcctgcactgtgggagattcacactgtgccaggtggagggagcaggacaactgctaacaggttgttggtgtggatgccgaggccacccaagcaggtgtaaactcccacctgtggggcagggaagagtgcacgggagacatgtcccgggcatagggtgagggagagctgtgggggctctgggttctgaagtgggttctgaagagggttctggcctggcagggataagaccaaccagcatgtgaggccaggctggagtctggacctctgaagctgcaagggtcatgggctgcttggccccaggggctgtcctggttctctatggagtactttcaaacattctttcttcttccaatccccctccttctctcccaaagcctgcatctcccaaatcctctttgtcggatcctcggcttcactctgcatccgtcctgagcatcgatcttccaattccatcctcttctcttctgctatgtctaagctgctgtgaagccacctgctgtaatttactgctttatatttaatattgtaccgtacatctgttctgtttccctcatcataaatgcttcatttcatgctcagcatctgagaacacaaggccttgtcagctgtcacctccttccgttctctgtttccttcctcctatccccatattgctcatcatgtccagtctcctgccatcctgaatgcttctgatggaaggtctgagatgtctcatgagcactgtgaagattctttgtaatgtgagcttgttccaggcaggaattctccttcacccagccctggaagccaagtataggcagatggccatgctcaatcaaagactgagctaacttaacagtggctttggttttaaggtttctccaatccccagggcacaggatttcagggaattcaggtgagagtctgggtgttacccttcaggaggctgtaaactccatttcacctagtctacaccacagactatggaaactatatatatatatagttctgtccctctagagaaacctaatatgtatatatacaatatataatacgtattatatattatatataatacgtattatatattatatatattatatatatattagagtttattgaggagtattaaactcacaatcacaaggtcccacagtaggccatctgcaagctgaggagcaaggaagccagtccgagtcccaaagctgaagaatttgaagtctgatgttcgacggcaggaagcatccagcacaggagaaagatgtaggctgggaggctaagccagtctagtcttttcacgtttttctgcctgctttatatcctggccacactggcagctgattagatggtgcccacctagattaagggtgggtctgcctttcccagtttactggctcaaatgttaatctcctttggcaacaccctcacagacacacccaggatcaatactttgcatgcttcaatccaatcaagttgacactcagtatcaaccatcacaagtccaccccttgtcaacttgaacccatacaaatctcctgagatcatacataatcttcaaataaagacaataataaggtcataattacacctaatgtaatacaactatcttttgtacaaccagaaatgcaccaatccccaacccaaatgctattatgtaaagttaagaacacttaaatgctgatatgaagtcaataaattttatgtcacatgataaaggaaaaaagaaatgaaggaattttcttagtacaagtgtgtacatgcacaaacatgtttttaacaaaagaagaaggaaatactgatgacaattacagtcctcatttctgcaactgatcacgtggttgtagctggtattgatgactaccttcttctactacccattctgtattccctttgccttcagcaagcatcacagcaggtagagttttttctcctagtggagtgatgcaaaccttcattcctgaagggtctgggccatttgtagtcctgcctggattgggctgttgtagtttcccgttgaccttaatgacagggcatggtaatgttaagagacgccctaatggatctcctgtattccatacatattcttccttacctccattgtggagtaatagactgattgcatcttgatagtccaggtcaatcagcccagccaacactgtaactcccctcttagcctgtggacttaaaggtaggaggggcccaaagtggccaggtggaaatctttacttccagtttaatggaattgttgttgtttctcctgatggcagcattattcccactggaactaagacctctaggccaacagaatgtaatgtcatgggaccaggaagcaaaaattttgctagtggatcactaggggtgatggtgaatggtgccatttccacttccaccccttgattcctggatccatgaattatggctatgggagaaagagtaccatatattggatgctgatttggagcatacatggccttttggagagctttgccccagccctgcaaagtattggagcctagttgacattgtaattgtgactttgaaaggccattccattcttctatcaatccagctgcttcaggatgatggggaaaatggtaagacaagtgaatcccatgagcatgagcccactgccacacttctttagccgtaaagggagtgccttggtcagaggcaatgctatgtggaatactgtgacagtggataaggcattccatgactccacagatggtagtcttggcagaagcattgcatgcatatctgcagtaagtgtctatttcagtgaggacaaacctctgccctttccaggatggaagaggtccaatataatccaacctgccatcaggtagctcactgatcaccctgaggaatggtgtcatttgggtagagacccagagccaaaccagatcacgccacccaacccctcccaaatctcatgtcctctttgcatttcaaaaccaatcatgccttcccaacagtcccccaacatcttaactcatttcagtattaactcaaaagtccaaatccaaagtcacattggagacaaggcaagtccctttcatctatgaacctgtaaaatgaaaaacaagtcagttacttccaagacaaaatgggggtacaggcattagatacatgctcccatttcagttgggagaaatgagccagaataaaggggcttcaggtcacatgcaagcccaaactccagtggggcagtcattaaatcttaaagcttcaaaataatctcctttgactccattcctcacattcagggcatgcttatgcaaagtgggggctcctacaaccttgggaagctctcaccctgtggctttgcagctctgaccccatggctgctctcatgggctttgcagagttcagccctcctggctgctctcattgagtgcatgcagcttttccaggtgcacagtgcaagccgttaatggatctaccattctggggtctgaaagatggtggccctcttctcacagccccattagtcactgtctccagtggggactctgtgtgggggctccaaccccacatttcccttctgcactgccctagcagaggctctccatgaaggctttgcccctggcgcagacttctggctggacatccagtcatttctataaatcctctgagatctgggtggaggatcacaaagctgaactcttctcttccgcacatccctaggcccaacatcatgtagaagccaccaatgattggggctttctgaagcaatggcctgagctgtacattggacttttttagccacagctagacctggagcagctgggacacagggcaccaagtcccaaggctccaaagagaagctgggccctggacccagcccatgaaaacatttttccctgataggcctccaggcctgtgattggaagggctgctgcaaagatctccgacatgccctggaaacattttccccattgtcttgattattaatattcatctcttcattacttatgcaaatttctgcagccaacttgaatttctccctagcaaatgtgtttttctttactaccacatggccaggctgcaaattttccaaacttttatgctctgtttcccttttaaaaataagttcctatttcagatcatctctctcaagggcaaagttccacagatttctagggcagggacaaaattccatcaagcttggttttatacattttagagaggcatgagacatcaatcaaatacatttaagagacacattggtttggtccagaaaggtggaacaactcaaagctagggcttccaggctataggtgaatttaaatattttctggttgacaattggttgagtttgtctaaagacctgggatagatagaaaggtaatgttcaggttaagataaagattgtagagtccaaagttcttttgaagtcttatagtggctgcccttagagataataggtgacaaatgtttcctattcaaatcttagttgaactctttaggattgggaggttctagaagaaaaagatctagctatgttaatagagattctttacagatgcaaattttcccccacaaagaacagctttgcagggccctttctttctttctttctttctttctttctttctttctttctttctttctttctttctttcttttttagatggagttttgctcttgttgcccaggctagagtataatggcacgatcttgtctcaccacaacctccacctcctgggttcaagtaattctcctgcctcagtctcccgagtagctatgattacaggcatgcaccaccacacccggctaattctgtatttttagtagacacagggtttctccatgttggtgaggctggtctcgaactcccaacctcaggtgatccgcccacctcagcctcccaaagtgctgggattacaggcatgagccaccatgcccggcctgcagggccatctcagagtatggcaaagaaacatgttttggggtaaaatattttgattttcttatttgtctcataatgttatgccagagtcagtttggaaagtaaatcatgatatataggtttaaataaaacccatctgatgagaatttatgatttgtagagcatgcctccccagactctttagataggaatttgggcaagatgaaaaaaaaatcagagtttagtcctcactacctaagaccagctcagcttggacttcactgttcatgtcactatcagcattttagtcaaaaccactcaataagtctctaggaagttccaaactttcccacatcttcccttctcctttcaagttctccaaactgttccaaccgctgccaggaggtacccagttccaaagttgcttccagattttgagttatctttatagcagttccccactcctggtaccaatttactatattagtctgtttccacagtgctataaagaactgcccgaaagtggttaatttgtaaagaaaagaggtttaattgactcacagtgctgtgtggttagggtcggaggctcaggaaacttgcaatcatggtggaagtggaagcaggcatgtgacacatggcagcaggtgagagagagaaagagagagagagggaatgaaggaggaaccaccatacatggataaaaccatcagatctcatgagaactcactcactatcaggagaacatgaggacagcatgggggaaaccacccctatgacccagtcacctcccaccaggtccaccccttgacacataaggattactatttgagatgagatttgtttaatgacacagagccaaaccacatcagcatgtgacaaaggtctaatatcaagaatctatgagggggcagttccaaaatggctgaataggaacagctccagtctacagctcccagcatgagctacacagaagacaggtgatttctgcatttccaactgaggtactgggttcatctcacgggggcttgttggacagtgggggcaggacagtgggtgcagcccaccaagagtgagctgaagcagggcgaggcattgcctaacccaggaagtgcaaggggtcagggaattcccgttcctagccaagggaagcggtgatggacggcacctggaaaatccggtcactcccaccctaatactgcacttttccaacggtcttagcaaatggcacaccaggagattatatcctatgcctggcttggaggttcccatgcccacggaacctcgcttattgctagcacagcagtctgagatcaaactgcaaggtggcagtgaggctgggggaggggtgcccacaattgctgaggcttgagtaagtaaacaaagtggctgggaagctcaaactgggtggagtccactgcagctcaaggagacctgtctgcctctgtagactccacctctgggggcagggcatagctgaacaaaaggcagcagaaacctctgcagacttaaatgtccctgtctgacagctttgaagagagtagtgtttctcccacatggactttgagatctgagaatggacagactgcctcctcaagtgggtccctgacccccgagtagcctaactgggaggcaccctccagtaggggcagactgacaccttacacggctgggtgcccctctgagatgaagcttccagaggaattatcaggcagcaacatttgctgttcagcaatattcgctgttctgcagcctctgctgctgatacccaggaaaatagggtctgcagtagacctccagcaaactccaacagacctgcagctgagggtcctgactgtcagaaggaaaactaacaaacagaaaggacatccacatgaaaaccccatctgtacatcaccattatcaaagacaaaaggtagataaaaccacaaagatggggaaaaaacagggcagaaaagctgaaaattctaaaaatcaaagtgcctctccccctccaaaggaatgcagctcctcgccagcaatggaacaaagctggatggagaatgactttgatgagttgagagaaggtttcagatgatcaaacttctccgagctaaaggaggaagttggaacccattgcaaagaagctaaaaaccttgaaaaaagatcagatgagtagctaactagaataatcagtgtagagaagtccttaaatgacctgatggagctgaaaaccatggtatgagaactacgtgatgaatgcacaagcttcagtagccgattcgatcaactggaagaaagggtatcagtgattgaagatcaaatgaaagaaatgaagggagaagagaagtttagaggaaaaaaaagtaaaaagaaagaaacaaaccctccaagaaatatcagactatgtgaaaagaccaaatctatgtctgattggtgcacctgaaagtgacagggagaatggaaccaagttggaaaacaccctgcagtatattatccagcagaacttccccaacctagcaagacaggccaacattcaaattcaggaaatacagagaaccccacaaagatactcctcgagaagagcaactccaagacacataattgttagattcaccaaagttgaaatgaaggaaaaaatattaagggcagccagagagaaaggtcgggttaccctcaaagggaagcccatcagactaacagctgatctctcagcagaaactctacaagccagaagagagtgggggccaatattcaacattcttaaagaaaagaaatttcaacccagaatttcatatccatccaaactaagcttcataagtgaaggagaaataaaatcctttacagacaaacaaatgctgatagattttgtcatcaccaggcctgccctacaggagctcctgaaggaagcactaaacatggaaaggaacaactggtaccagccactgcaaaaacatgccaaatcataaagaccaccaaagcgaggaagaaactgcatcaactaacgagccaaataaccagctaacatcataatgacaggatcaaattcacacataacaatattaacctttaatgtaaatgggctaaatgctccaattaaaagacacagactggcaaattggataaagagtcaagacccatcagtgtgctgtattcaggagacccatctcacatgcagagacacacataggctcaaaataaaggcatggaggaagatctaccaagcaactggaaaacaaaaaaaggcaggagttgcaatcctagtctctgataaaagagactttaaaccaacaaagatcaaaagagacgaagaagaccattacataatggtaaagggatcaattcaacaagaagagctaactatcctaaatatatatgcatccaatacaggagcacccagattcataaagcaagtccttggagacctacaaagagacttagattcccacacaataataatgggagactttaacaccccactgtcaacattagacagatcaacgagacagaaagttaataaggatatccagcaactgaactcggctctgcaccaagcagacctaatagacatctacagaactctccaccccaaatcaacagaatatacattcttttcagcaccacaccacacctattccaaaattgaccacatagatggaagtaaagcactcctcagcaaatgtaaaagaacagaaattataacaaactgtctctcagagcacagtgcaatcaaactagaactcaggattaagaaactcactcaaaaccactcaactacatggaaactgaacaacctgctcctgaatgactactgggtacataatgaaacgaaggcagaaataaagatgttctttgaaaccagtgagaacaaagacacaacataccagaatctctgggacacattcaaagcagagtgtagagggaaatttatagcactaaatgcccacaagagaaagcaggaaaaatctaaaattgacaccctaacatcacaattaaaagagctagagaagcaagtgcaaacacattcaaaagccagcagaaggcaagacataactaagatcagagcagaactgaaggaaacagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaactagaaaatctagaagaaatggataaatttctcgacacatacaccatcccaagactaaaccaggaagaagttgaatctctgaatagaccaataacaggctctgaaattgaggcaataattaatagcttaacaaccaaaaaaagtccaggaacagatggattcacagccgaattctaccagagctacaaggaggagctggtaccattccttctgaaactattccaatctatagaaaaagagggaatcctccctaactcattttatgaggccagcatcatcctaataccaaagcctggcagagacacaacaaaaaaaaagagaattttaggccaataaccctgatgaacatcaatgcaaaaatcctcaataaaatactggcaaaccgaatccagcagcacatcaaaaagcttatccaccatgatcaagtgggcttcatccctgggatgcaagtctggttcaacatacgcaaatcaataaacgtaatccagcatataaacagaaccaacgacaaaaaacacatgattatctcaatagatgcagaaaaggcctttgacaaaattcaacaacacttcatgctaaaaactctcaataaattagatattgatgggacgtatctcaaaataataagagctatctatgacaaacccacagccaatatcatactgaatgggcaaaaactacaagcattccctttgaaagctggcacaagacagagacaccctctctcaccactcctattcaacatagtgttggaagttctggccagggcaatcaggcaggagaaggaaataaagggtattcaattaggaaaagaggaagtcaaattgtcgctgtttgcagatgacatgattgtatatctagaaaaccccatcgtctcagcccaaaatctccttaagctgataagcaacttcagcaaagtctcaagatacaaaatcaatgtgcaaaaatcacacgcatttctataacccaataacagacaaacagagagccaaatcatgagtgaactcccattcacaattgcttcaaagagaataaaataccttggaatccaacttacaagggacgtgaaggacctcttcaaggagaactacaaaccactgctcaatgaaataaaagaggatacaaacaaatggaaaaacattccatgctcatgggtaggaaggatcaatatcctgaaaatggccatactgcccaaggtaatttatagattcaatgacatccccatcaagctaccaatgactttcttcacagaattgggaaaaactgctttaaagttcatatggaaccaaaaaagagcctgcaatgtcaagtcaatcctaagccaaaagaacaaagctggaggcatcacgctacctgacttcaaactatactacgaggttacagtaaccaaaacagcatggtactggtaccaaaacagagatacagaccaatggaacagaacagagccctcagaaataatgccgcatatctacaactatctgatttttggcaaacctgacaaaaacaagaaatgggaaaacgattccctatttaataaatggtgctgggaaaactggctagccatatgtagaaagctgaaactggatcccttccttacacattatacaaaaattaattcaagaggattaaagacttaaatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtaaacaggcaacctacagaatgggagaaaatttttgcaatctacttatctgacaaagggctaatatccagaatctacaatgaactcaaacaaatttacaagaaaaacaaacaaccccatcaaaaagtgggcaaaggatatgaatagacacttctcaaaagaagacatttatggagccaaaagacacatgaaaaaatgctcatcatcactagccatcagagaaatgcaaatcaaaaccacaatgagataccatctcacaccagttagaacggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgcggcactattcacaatagcaaagacttggaaccaacccatatgtccaacaatgatagactggattaagaaaatgtggcacatatacaccatggaatactctgcagccataaaaaaggatgagttcatgtcctttgtagggacatggatgaagctggaaaccatcattctcagcaaactatcacaaggacaaaaagacaaacactgcatgttctcattcataggtgggaattgaacaatgagaacacttggacacaggaaggggaacatcacacaccagggcctgttgtggggtggggggagtggggagggatagcattaggagatatacctaatgttaattgatgagtttatgggtgcagcacaccaacatggcacatatatacatatgtaacaaacctgcacgttgtgcacatgtaccctaaaacttaaagtataataaaaaaatttttaaaaaaagaaacacctgcttttttctgttttccatttgcttagtagatttttctccatccttttactttgagcctggggatgtcattgcatgtgagatgggtctcttgaagacagcatacatttgggtcttgcttctttctccaacttggcaattctctgccctttaattggggcatttagcccatttacattcaaggttaatattgatatgtgcatatttcatcctgttatcatgttgttagctgctcaatatgcagatttgattgtatagttgatttatagtggcaatcgttatgtacttaagtgtgtttttgtggtggccagtaacgttcttccattatcatatttagcaatcccttaagggcctcttgtaaggcaatctagtggtgatgaatacccttagcatttgcttgtctgaaaaggatcttatttctccttcacttgtgaagcttcatttggctagatatgaaattcttgcttggaatttcttttctttaagaatgctgaatataggcccccaatctcttctggattgtacagtttctgctgaaacctccattgttagcctcattgggttccctttgtatgtgacctgaaccttctttctagctgcctctaatattttttttcctttcaacctttaagagtctgatgtctgatggctatatgtcttagggatggttgtcatgtataatatcatgcagaggttatttgcatttcttgaatttgaatgttggcctctctggtgaggttggagaaattttcatggaggatagcctgaaatgtttttcaagtttctttttttctctttctcttcttaagggataccaatgtgtcatagatctggtctttttacataattgcacatttctctgaggttttatgccttcttttttattctttgttctttatttttgtctgactgagttaattcagagaatcagtttttaagctctgtgattctttcctcagcttggtctattctgctgttaatacttgtaattgtattctgaaattcttgaagtgagttttttagctctatcaaatcagtttggttctttcttaaaatggccatttcatctttcagcttctgtatcattttactttatttcttagctcccttggattgggtttcaacattctcctgaatctcagtgatcttctttcctgtgcatattctgaattctatgtctgtcatttcagccatttcagtcaggttaagaaccattgctgggaaaccagtgtgattatttggaggtaagaagacactctggattttagagttgcagagtttcttgcattaattctttctcatctttgtgggctgtttctttaatctttgaagtggctgtcctttggatgtttttgtcttttttgttgttttttggtgtgtgtttttgtttgtttgttcatttgtttgttttttgctcttatcttctttgatactcttgcaggtttgattgtggtataaagtggattcagttagctgtgtttcttgaaaatcttagagggtccaggctcacctcagcactcttgtggtgtgttctctgctctgggactgggcccctggctttattctctggccccttgagtttagaaacttgctgcattggaggggctgaggtgttcccagtccattggccacaacactatagtagggggtgccggccaaagcacttcattagagtggtggcagtgggatccattcttactcatgggtgccagcagttgtggagtcatggcagggtgcacatgcatctgctggggtgggggtactggcaggagcagagtggcagcatccctacataggttcctgctggcagtcacagcgcagtgaggtgcccgtgtgttggcagggacagggtggtggggcacacatgcacatgcttgctggtggtagagggagttgtgatctgctgtgcactcatgccagcaaagcagttgggaggtactatgggtggactggtgcacatcagcagaggctggcctgctggaggtctccaatggttaggcatggtctgctggcaaaggagctatgatgagggcccccaggaaacaccctggttgggcttccaaggctgtactgcaagcaggcacagccagcctggggccccaggagaggccagaaggcaaggaaattctcatttcagatgggccctgtcccatggacaagaccaccctgctttattcaggtcccatagtcactctaaggttaaaatctcctagaggaggttggtgagccttgggggatgggtgtcccctggctgtgctccactacagccattctcatgtcaaacactctgggctttacacagactggagtcctgcccctggcatctctctaagcagctgtcccttccagcacaagtgtccatgggggtcatggggtctcctgctgctaggattctggaggcccatggcaacagcaggccactcctcacctgttcaactcaacctttccccaggagttgctgggagccaggaatgagtcctggtgcttggcatccccatgcagggttcccatcttcctccaccttcagctcagcatctgtgtcctcccccgtctactctcaatccactctcaatgcctccccttcaaagatctgcttggaaagcacccgtcttcctgatgtctcactccctccatggcagatattcctcctggctgcatctagtcagccatcttgactcgcctccaaagtctttttaattaccacttcggttaaattagtaactatcattttacaatggcctgtgattctgttttgatcaaatattttgagccttttagcatctataacaaatgttctcaaaaatcaaaatcctaaatcaagtctctgccttagtcttatttctggggcttattaaggctataaaaattaatcaccataaggttgtacaagctttttacagcttccagtcaggctatgaactccagtatcaccacctccagcctgataattacatatattggaagaaaatcagttaaaggactccctctagacccttgaaagggtgtgagagacaacatggtttcgcctgccttcatgtgtcccagtccatccctgtggctgcctctgtccacctcagcttgcccactgtctttccttcccaactgtctgccctgctgacttctggcctcagtgacagatgcaaagacaaggcgacagccccacatagaccgtttaaccagtcccacatttgcataagctaaatggtcatgtcacagtctgttgcccaggctggtctcaaactcctgggctcaagtgatccacccaccttgacccccaaggtgctgggattacaggcttgagccacagtgcccagccaagaacccgtttttgagtgggcaccttggcacacacctgtaaacgcaacactttgggaggccaaggtgggagtgtggcttgaggccaggaggttgaggttgcagtgagctatgatggcaccacctcactccagcgtgggtggcagagtgagatcctttagaaaaaaaaaaaaaaaaaacttgttttctctgcagccgggctccgtgaccaaacacaaacacaaacttcccctccagagggtccaggaggggctgggctgcaggaggtgcttagggcctcttagggaatggtaagtgaccacccaacgcaggcactcagccccaggggcatatgcagagagagggtccaggaggagctgggctgcaggaggtgcttagggcctcttagggaatggtaagtgaccacccaacgcaggcactcagccccaggggcatatgcagagagagggtccaggaggagctgggctgcaggaggtgattagggcctcttagggaatggtaagtgaccatccaacgcaggcactcagccccaggggcatatgcagagagaggctgggaggacactttcagtgactggggttacaaaccccaaccataagacattgctggctctgtgagccgccacctccagaaatctcccacttagttcttagcacttatccactcttcccttttcctactctcaattcctggaggatgccctcctttctcaggctcagaccaacctaccagctccactctagacctgaacacatgactcctccctctgtctccacctggaaatctcatcagtgcctcacatttacactcctgaaaatcaggtcctgcctacccaccctcttgctccacctgattcctgccctgtttcagccagagaccttgcagtctcctttaactctcaaacccacccatgtcgtgtgagcatactgactgtgttctatgcaagaaagagcagtttcttggtggtcctgcggttttattagtccagaggcaaagcgttggcagagctggtttcttctgaaccctgggagggagattctgttttcatgccttttccagattctagaacccatattccttgctctgtgtccccttcttccatcttcaaaggccatcctctcatctctgtgtccatcatcacatcacccttcccctgactctggttctcctgcttccacttataagcacccttgtgattacatcatacccacccagacaatgcagggccatattctcccctctcgagattaatttaatcacatctacaaagttcctcgtgccatatgaggtcactaaaccacatgttctgggggtttgaatgtaaacatttgggggatgcattattcagccacccacaagcactgctccccactggccacacactatgcacagccgagatcatgcaagtgaggcacgttcatcaacagcagcttcagcaggaaactatatgctccactttcctgccatttgtatctggatttttttttcgctatcattgtagaaagagtggtattgtaaaattaaagatggattattttctttctagaacactttggcaatctatccaacattatttatccccttctgagtgtcaagtgtgaggtcattctttcattgagagctcaatgcctacaattatgataatgcatattgggtactttcacacatcagaaagttcttctttcttaaaatctgttcttgaattattcattcttctctagctttttgttgatctattttataattttagaaaaatcagaaagtaacttgaagtatctgtcatctctacaggtttacctccctctttgtggccttcagaatgtcatgacacgcttttcccttgctcatcacatggtttctatgtatgagacctcatcacaggagctgtggtcccccgggagcaggcatctgtggatggtgccttgctcctggctgctgggacctgtgtgctgccagtggcactccacgacagtgatttcccagctcagttttgcagctccagatggtgggtgagacactaggaccactttgtgaacagcgagggcttggggtttgcttttctaccatgtccagggctgctgttcatgagggaatgtttctaacctgacatcatggctgaagccaacttagaacctctctagccgtatggggagtaggtgagtgatacagatgttaattagctcagtggagccactcccctatgtagacatgttacaaaacattatgctgtacagaataaatataggtcatttttatgtgtcaatcaaaagagaaactaattatttaaaaaaaaaaaaaaaacctctctactcaagccgaaacctcagctccagtcccacaagtcacacaaggctgctcccgtcctgtgtatgttaaacctacctcagaaatgcaagggggcattcaggtttcattctcaattcaaatgccctttttaattttgtctattcctagcacctggcaacttccagctctttttttcggggctcattcattatttaaagcacgtataatttttcacccacattctaacacatgtagtactgtagagaatccttccctaggaggatctacagcattagaaaagaattaagaactccaatatttacaagaaggaaaaagcaaaaagagatcaaaaaatgggcaacttctagaaatagaaaaccctcatgagtatgatgataaatcgctggcacacatgtgaatagttacttgatgcttatagtgatgtctgggaaaataacatgaaatacttataatctgtttctcacacatgtaattcaaaagaatagagagaagatgatttgaaatattcttaagtttgtaggaaaaaagctacttccatatgcataattgcatgtattttgatactgccattattaagaactatctaagagggtccattaaaaataaaatttcttggctgggcacagtggctcatgcctgtatcccagcactttggaaggccgaggcaggtggctcacctgaggtcagaagttcaaaaccagcctggccaacatggtgaaacgctgtatctaccaaaaatacaaaaattagctgggcatggtggcatgcacctgtagtctgagctacttggggggctgaggcaggataatcgtttgaacccaagaggtgtaggttgcagtgagctaagatcataccaccgcactccagcctgacagacaaagcaagactctgtctcaaaaatattaaaataaaatttctcattcctattacagagtaatttaattcattaatgccctgccctgttacaaaactcatttgtaaaatactaattgtaattgtgaaaaaatggcaattgatactaattttaaattctaaaaacagggcacccatattaaagattattctgcagtaagagaattagctataacattttgtaataaggtggagaaaacattctccaacttacaatggttggtgagaagaaagtttccagcacggtagatggaccctaagagcccttgttgaaataataagacaaaaagatatacagagagatgagccagatgaagggagacagagagagagagagagagagagagagaggcacagaaatgagagatacaaagtgaaagagggcaacctgtggggtcatcagatatttgttttctgttttgtttattctaacataaaggcagtggtgggtcatcgatgtatttagagtttgcacaatcactgtggaacacagacagacacaggggaagaggagaaacacagggcggtggcttgcccttggactgttcttagttcctcaaaacgtaacagctttgcccaacctaagggaactttcagcagctgctcttctgccataggcctctttcctgccttgttttcatgtggctgactgtttctgttcctgcaggtcttagctcatcagacaggcatttattacctctgtgtcaacagtgggagcttccattactctctagcatgacactccccttcctcttttaggaaatttaacatggaagtgagtttgccatcggccttctccccacagtgttaacagtggtgaggaagccagcctgttccaccttgcccctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaccgcggatcctctccctatagtgagtcgtattagcggccggccgcctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaacttggctgagggcttgcaaaacctgtggaattctcctgttgcaagggctgtagatgtttgcagtggcagtgggtgctggcgggaaatctgcttaccttttccctacatgggaagtccctcctgtgtccagaccaatccgatctgggtggggaagacaaggctgcaaaggccaggtgcctccatgctgccctccgatcaccacgggtgcgtttccacacctccactgcactccgtcagtctcccttcaacactccagtcaaaccttagctgtttcttctttgccttattccttcctcatggggagggtgtgggtgaacaccaggcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccaggttgggaggcattggtttgggtggtggtcaggaagggcagagtgatttgagtagggtctgagtggataatagctcatcagtttggaatttataaatgaccagggatgatttaaggagattcctgccagacacctatgccatggccatgccctatctggatctccagccgtgagatgagaacccagccatgcgggggagtctgttcgttctgctcaatgttgtaagtggcacatgctattggataatgtagaattgaatggatatcattttattattataatttacaaacttcctacaataaacttatcacctttatacatagaaacaaatataagtacattttccctcccctatgtcattttgagccctctctccaaaccatcctcccactctgcgactcactgtcctgcatttggctatgctctggcaagtcctgcttagacaagcactcaccagaccacctactcagcctcccttcagcgcccacctggcccacctgctcaaatacatgttgagtggtcacacacatggactgaacaccatctattccatgcactgccccagtgaccgcactgagcagcaagagagaaatgatcgcattagctatcaattatgccaattcaaatgctggagtctttctcagatacttttcaatgttcaagaattgttgattgtgaattctatacccaatgaaactatccttcagaaatgagcagaaaatggataccttctcaaataaacaaaaactaaaagaattcttgctacaagatgtactcttaaagactggctaaaggaagttcttcaaacagcaaggaaattgaattgatcttatgtcctgcacacttgctaaatttcctctcaattttagcagcactgtttagattccataggattttccatacaaacagtcatgtggtctatatatagagacagattttcctcttttccagtggggataaatttatgtctttttctttctgtgttacagcaggtaggacctccagtacaatgttaaacagaagtggtgaaaacagacattcttgcctgtttcctaacgttggagtttggtcttttactatggtgtcagatgttagctgtagggtttttataaatgcccttcatcacattgaggaagtttgctcctatgcctaattttctgagagtcttttaatgtgacactcatgctagaatttattaaatgctttctgtctactaagatgattatgcagttcttatattaacatgaataattacatttatttattctttaatatcaaggcaattttgcattcctgagacaaaccccatttagtcatcatgtgttgttattgttacatattgttggattcaatttcctcaaaatttgttaagaattgttacatctatgtttacaaggaagattagtctgtagggtattttttcttataataactttgcctagttttgcaatcagggtaatgctggactcacagaatgagttgggaagctatttcctcctcttcatttttctgaaagaatttgtataaaattggaattatatcttccttaaaggtttgcaagatttcataatgaagtcattggcctagagttttctttgtgggaaagtctttgtttgtttgttttgtggtttgggtttttttttaagagacacagtctcactctgttgcccaggctggaatgcagtggtgtaatcatagctcacagcagcctcaacctcctgggctcaagcaatcctcctacctcagccttcagagtagctgggactacgggcatgtaccaccacacccagctgtttgtttgtttgtttatcgctttgtcttgtttttgaggtcttattatgttgcccaggctggtcttgaactcctggcctcaagtaatcctcatgcctcagcctcccacagtgctggaattacaggcatgagccactgcacacagactgtgggaaagtttttaactaaaaattcaattttctcttccttttccagtgagctttccagtgtctttcaattaatgtatctattttatctaagttgttgaatttattgtcaaaatttttttaaacaatattcctctcttagaggttgaacatctgtagaatctgtagtgatggcacctcttaaatccctgatcttgctcatctgtgtcgtctctctttctctaatcagtatgcctaaagtttaatttcattgattttcttaaaaaactggttttggttttattgatttttttccctagttttttgtgttacatttcattgacttctgctctgatatttactatttcctttctactgcctacagtaagtttaatttgctattttcttagtttcctaaagtggaagctaagtttattgacttgaggcctttcctctgtctggatgcggatatttgctgctaaacatttccctccaacaccatgctgtgagttttagttacagcgggcttggagttggcctgagaaattctacttaaacagctgcacctatcatgtaagtgataaatgatgtacctgcctggccctcacccctggtcaaagaatgggatgtactaatgagcaatgttgctgcgtagctgtggatttcaaggtattttctgtgtggttttatcatcagcattgtttgttgatgactgcaagactgatgatttgcacctggcctcggtgagatccccgaaagaccctgcagatgggctggttacttagcagaaaatatgacaacgtggccagcaggaaacaggaaggtacaatcggctgcaggtgagctgttggaagtaagttccaattttcctattttgtatttgcattttaatagtgagactgcgcttatgttatttgtgtgaaacagctttattcatagcactgtaatttaaagagaaaacccattcatgggaacaacaaacgacctagacaccaaggtagctcatgccatccaaggctatactgtgcagtgattgggaaaatgggcactggtcccagaagtctgatcgacactctgccactggctagtcccgtgctggggggcgaggatccacactctgccactggttagtcccatgctggggacaagtatccacactctgccactggctagtcccgtgctggggggcgaggatccacactctgccactggttagtcccatgctggggacaagtatccacactctgccactggctagtcccgtgctggggggcaaggatccacactctgccactgattagtgttgtgaagatttaaataaagaacccacaccatattctttgacttgtgctttccgtatactgagagatagtaagagtacattattattatttataaagtaaactagaaagcacatgggaagacaagaagaaaacctgaataaacatgaattaccccattttcctcaggagaaaactttcacactctgaaggtacacaaattagcctacaaatttaatgtaaagcaaatagactgttgtaggtaccaattctcaatgtcacagtgttacatggaaagtaaaatacacaagaacagcccaaaagatggaaacaatggacgtggtcaaatgacatcagtacaacatccatatggtcctaagtagccatctttaaaatgggttagaaatgccttcaatcattcacacagacacatgcattgaacaaactctaagaagtgttcttacacgggaaaagcaagttacagatgcatgggcatgatatggatgtagatgtgtgtatgtgcatcccactcatacacaaaatacccagcatcgcccacatgcctgctgtgtgcgtaagtgtgagcgagtgcacagacaacagcgtgcagaaattcaaaccaagctgtgggtacttgttaccactgggaagggagtcggtcacagagggaaagagaaacaggacatcagcctttgacttcagaactgttcctgccttttcacatcctgtgctgttttcagcatcatcggagcccttaacacacatcacgggagtaagagtgtgttagagggagcattcggtgggacagatattgccatggcttgtggatagagttcacagtccttaataatccccgagatggcagccaagagctacgttctcaatcacgcagcttcaccccagaaactgacagaaacccaacaaccaaaaggtgtccattctgacagcctcagcctgtgctggctcagatgagcaaaaatgtacagatattaataatgatgttgatttgaagagcacagaggggggtatgcatgataagggtccaaatttttaccttaaaaaagaatacatttacttctcaatcacctacataacgatcattttttaaaaaactgatcaaatttggtgttacaagggcacgttgcaaattcttctggctacttttctctgactattctaattacgttaccgtgttttctcctgtatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatttctggctacttttctctgactattctaattacgttaccatggtttctcctatatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatccaggcagatttcccaaatccggcttcctgtaaccaagggctgaaagagggaacggtttcctgggaatcctttttgcagtttattttacccggaggcagaagcccacggttccgtgaagagtctattgctctcccctctctccttttgtgtctctatttttaattgacaaaaaagcaaatgtgaagattcctggggtacaatgcaaagtgacaatgcctgtctatattgtgggatgattaaaacaaggtaagtggcatatccatcacctcacacacttatcattttgtggtgagaacatttaaaatctcatcttttagcaattttgaaatagtcattattgttaactatagtcaccatgctgtgcaacagatcaaaagaactgactcctcccatcagcagaaacttcatgccctttgaccagcatctctcctttccccgtccacgactaacccccagcccaagagaacagccaacacccacctcgctgctgccacacgacatgtcgggctttgatgggatggaggtgagggtggggaagacaattccaaagctggagcactggcctcacagctcagacactcttctacttatcctgagagaatgatgtgctgagaccaactaaacctcccctgctcttcccacatggcagaaaagaggcaacccagggaagccattgccaggacatcatggtcacccaacccttgtgcagaaaggaagcacctgcccaggatgccatagcacccaaccctcatccccaaggaaacacagcccagggcaccatggacacccaaccgtcatccccaggggaggacacagcccagggcaccatggacacccaaccctcatccccaggggaggacacagcccagggtatcttggacacccagccctcattcctaggggagtacacagcccagggcatcttggacatccaaccctcatccccagggaaggacacagcccagggcatcttggacacccaaccctcattcccataagagcacacagcccagggcatcgtggaggcccgaccctcatccctaggggaggacacagcccagggcaccatggacacccaaccctcatccccaggggaagacacaacccaggccaccattaacacccaatcatgtgcagggagggtgtccttggagcctgggactcttgccagtgaagcggtggacaagaaactgaggatgcgatcagcacacagaaatctcaggcagcctaggatacatgaggcctctcacccctgggaacactgagcagccaccaggagcccacaccttgaggtacagcaggagccatgcgctcttgctcttgctcactcacactcctgcacacagccactgacacacgccctcgtgcacgttgcagattaactccactggccttgcacttgcaacgctggaggctgagaggtatccccaggttcttttctcgtgagaggggcaggctgactttcactctcctccatgtgctagaggcagctccaccaacactggctgccctgagtggatgcacctggctctggaattcctgtcatttgctttggatccaggagcccctgcctcatgtagctacttaacagaaaggaggaatccacccaggacatgcccagacgggagcctcacaggatggacagtggtgtctggggtcacgggcagccctgacccagcagcgccagcaccagcacacccagtggggaaggcggggaggcccaaacgccacccacagtttgttactccactgggtgggacccggcacccctgccttcctgacaccctggagtccctgcctcctcctagagcccccaagcccatctgcctcagagcatccagagacagacctggggagccatttcctcaggccctggacaaggaaacagggaattccaggttatgggtgcctggggcaggtctcaggcaggtgctgggaaccagagagaggggtcaccgcgaggcctcaggcctggcaccagcactttgagcctcagtttaccagcccacgaggtgctgagtctggactggatgaccttcccacccccagtgacctctgccctttcccgagcatgtcagctctgctccagcatcctggtgtgagcgcaatgccactttttttctcaacaaatacgaaaggaggaaggtgcccccagggccctgtgccctgaggatgcctgtgtggaggggtccatttcatcactggtgtcactcacaggaagggacgaagccacctgccttgacggagcttactccacctccgccgaaggccggggaggtccctcacagagaacctgaggcccagcaggctgcagaggtgctggcatggaatgactgctcagacgcccggggccggcagagaggacggatgtgggggaggtgcacactgaggagcctctccttggaggtggagacacgtgcaccacatggaccaggacacagtccacgaagcctcgcatccccctgagctgcagctcaagggcctctctctgagcccagagtcccacccctgggaggcagctgccccagctctgagggaggagggcatccaccaggccctccatctcctgggggcaccagcccagcccagaggctctgcaggactctgcacctccaattcatggccaggactttctggatgtatcttaaggactgaggactccacatcagggaccacacaagaccggggtcccggacacgggggttgggggtgagcatgtcaccgggatgggctgtggcgtcactctggtacttcatccggacagccagggaccaaagccacgccctcagccccaccccacccctgcctcacatggcaacgcagggtctgcagatgcaggagagtgagaagcatggtagccaggcagactagaggacccgagctggggttgagcacctccctgtctacccagggcatggcctgtgagactgcaggtggcctagtgtgtgctgcaggctcaaggtcctgccccagggagcatgacattcaggcccagaaattgcatcgtgctgcacacagtccaaggggataaccctgtgaagttcaggtcaccagcaggcttggggtcaagaccgagctgcagaggacaggtttctggaaggcacagcatcatgggtggagggacttggagcaaggtccttagccccgggaccagtgaatgtgtgcccttatagggaaagggggtctgtgcagaagcaagttagctgaaaatcatgaagtggagaggctcccctggattaaaggggtgagccctaatgtaatcacaagtgtccttctaggaggttggcagagggagactgacatagacagaagccaggtgaggtgggaagcggaggcagaggccgagagagcagacgctacgccctggccctgaagacggaggaggagccgagagctcagggatggagagactggaggaggcagggaagttctccccgcaagcctggagggagcatggcctccagcacccccagaccttggccctgcaggattcatctggacctgtggtataaatggtgtttaagccactgggctgtgcaaattgtcatagcagccatggcgcattcctagagggagccctggtggggacccagcaggcagcgacggggccctcacaagcctgtgagccactcagagccgcgagagtggctaggcttggtgaggtgcaggccacgcgcacctccactaaggcagccttagggcccacacatcctctctctctctctctctctctctctctatctctctccctccctccttccctccctcccgctctcttggttggacagctctccatcatccccctggacacgaccacctcccaaggccgagctggggcgctttgctcgaggtgagcactgacatcctgggggtgtgaggggcacctgcccagcggccccgtgtgcaggatgggcggtgggccctagctggcactgggcatatggcccggctggtgcctgcaggctgcagcttttctggggtggctgggatcagtgaaggcctccagagtctgggcctgggatccctgcagtgctggctgaggacaggcggggctgggcagtgagggcactgggtcactatcaccacccacggtttattacttcactaggtgggacctggcacccctgccttcctgacaccctggaatccctgcctcctcctacagcccccaagcccatctccctcagagcctccagagacagacctggggaggcatttcttctgcccccagcagaagcccgggaggccgggaaggcacagtgggtctaaaggagaggatcccaggactgcctgaggggtgactccgacgaggcaagcatagagcccactgagaagcggggtgggagccccaccagggatgggctagttcctcatgaaggaccaggacccaggaaggacaagggggcctgctggggcagggtctgctatgccggagtccctgtgagcctggcccagacctgcctctctctttcctcattggtccccacaggtccgtggtggttgccgtatcgggaggccccatggtggcaggggtgggacacctggtatacgtcgccaggtgtgtccaataggctcatgctcacaccttctcctggcacctgggcaaagcctgagcacccaggcactgaagtgagggcaaggcctcggggccccacaggatggccgaggagacagctgcagggcgcctgggacccctgggctcaggaggtagaaggatacagcctgaaaacccacaccacaagctcaccggccagtgcaggcccacagagctcgaggaggcagccctgagcctcccagggagagatgctctgtgcacgccggcacaggccctgggttacaaaccctaggcacagcccaggagaggcccaggccccagtccagcaaggggttgcaggaagcaagaggtccccggccacagcatgagataagcccatcaagccagggccaggtgggcaatgggaggcaggcagggcttgggggtgagtccctgctgcagcgccgtccactgtcgaccggaggagtttcttccctgtgcggagtccacgggcctcctgtgagtgtgtgcatgggcacaagtgtgtgtgtggctctgctgtgtgtctgtacacacgtatgttttgggtttttttgtgtctcagaccacagagtctgcccctcccaccaaagcccaggcagaaggatgaacccacgcccctggggcccaggcctcagcagcctctgcaggatcattgttcccagttgtcacttgcctttgccacagccctatttctccacaattccttaaagtcctcaacatgcatttaaggcacaaaggtgaaactgcccagaaacatctgactccgccgtggaacccaggagcaagctgggttagctaaggagcggggccgttggcagaggctggggatccaggctgaactttggaggaggcatgtgccagcatgggctcctgactatgtcctcctgggacaaacccaaacccactctttgaatatgggagggactttgctggccccggccctgaccgcagcacttggaaactgaggagtggtcgcctcctccgtgtcacagctgcccgttcaccatcatagaagcaactctgtcacctccatgggcccctctgtggctgctgcctgggtccaagctgagcccagctgcccaggcccagaaggaaagcccaggccaggtgcccagcacagaggcagtcacataccccggggagagccacagcaagcagccaatgttgcccaggagaggagtagctgacaaggtagaacgtgagctgccatcggctcgagaggctttgctggtcctcctggggctctggacatgaccaggaggagcgagggaagaagtcgcatggtggtcccatcctgggtggggcctgatggcagctggccacccgtcccagagtggcagccagatgccagcgccattcccacagtcacatcattggtcacagaatgcaggacatagagtgtcttctttccatcacagtgctgtccagacccatagcctagggtagacctggaagattcaatgtccacacccggggctggagcgtagccatgagccacgccccctgcccgtgcatggaaagccagcccaagctctgctccatccctagccaaagtcagtgtcctttccccttctcccaagtgagctctagccacctgcctaccctgccatctgaggatgacagccttcattccattggaacctggctctgccaccagcaggcttgcagtcctgggcagactccgtcacctctctatgcctcagcctttccatctgcacaggaggaagatgatgatggtggtgatgatgatggcgatggtttccttttgcatctgaggcaaggactaattgagatgatacacatcaggcactgggtatggtgctggtccttcctgagcactcaatctatgtgagctgtccttgtgaaatgggtgtcaccacatttccccacgcagaacatcctttgtctgccatacttgaaacatctgccccaatattaacagttccttcatggaagatgtgcacacccacccaccctcatactcccaaaggtgcccgtgctttatcaagccaaagtccagccaggaactttacagcagcatccctttccctctccaagcaccaaggagcaaggcaaagcactacatcttccatctggaggcaatgccaccctcttctcccattttcactgccatccctaagaggcagtgcttccccaaaaggttccatagcagcctgcctacagcaactctgttcacacgagtttcagcatccttgcagtggctcccctgccatgctgtggctcttcattcaccctcttctcctgctccccgtgacaggcatagattctgagtgatctggatacattgctttgtttaataacattacagcttctgtgctgaaaaagatacagcagatagagaaggcaattgttgaacacaaaatagtgacagcagagatgacggcaagttggcatttttcttttctagcaataaaacttaaagctgactcaaggagaaatggaaatcataattggaacagtaatcctcaagaaagcattaagattattaaataattgccctcacagatgacttcaggccaagatggctttatgggtgaagtttagactttcacaaaactaatcagttcccataagaactgctccaggatttggaggaacatgggaaagtctattaaagggatcacaattcacagtccccagagtaaaacatgggctaacttgcattttggcaaagagccaaatgttataaatgacatcctagaaggccaaattctgtccatctcgttgaacaaggacttacaccaggaatttagaactatttatagctcatcccaccactcaggccaatgatgacccatgatcatctcaccagaaatggaaagactcagatgattaatagagtctcaatttctctgagacatctaagagcccagcccaagcccagacccaggagggcacccaggcctggacagagaacactgatatcacaccagccctccagagggaagcagagactccttcaagctctggaaacacaggcccagacagctgcctaaagttgggcaggcttcactgcaaacccaaatcatgaagctaggtaacacctttacagattctttacatttaaaaatcatcaaaacaagagtaaataataaactcaaataatattaatctaatatgtaaaggtcttgtaccattattatgcaaacaacatacataagctaataagaaaaagaacaaatcccttaagaaatcggcaaaaaggatataacacaatttctaaaagaaaacaaatggctagcacacataaggaaaacactttgtgaacagacattcttcagaacattatttataattataaaatagttgaaagcaagatagtgcctgaagaaattatggtgcatacattagtgggactattctgcaaacattcccaattatacttgtcacatatctgtgataacgtgacagccagcattcatggggtgacctcatttggtaaaagggtgcaaagctcaacacgcattgtgagatgactgtggtgtaaaattagtgggattattccgcaaacattcccaattatacttaccgcatatctgtgataacatgacagcattcatggggtgacctcatttggtaaaagggtgcaaagctcaacacgcattgtgagatgactggtgtaaatacaaagaccaaactgtgaaaaggagtccatcaattaatcgatgcttaccttcagttttgggctaatttttaaagtatgctataagcatatgctcctgttataacagaatggagggattatgagagatgatgcaggtgtgtcctgggcctcccctggcccactgggccctagagatgccttcccaggcatcgctgtcagggcttccctcagagggagtcctgtattgacctcaccaccaaggtctggagcaggggatccttagatattggttggggttatctcaccttaggtctgaatttggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccaccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggcgagggtctagtgcaggtgcccaggacaagaaagattgtgaatgcaggaatgactgggccacacccctcccgtgcacgccccctcctgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactccacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactctctcctggcccctgctggaggccgcgccagagaggggagcagccgccccgaacctaggtcctgctcagctcacacgacccccagcagccagagcacagtggagtccccactgaaccccactgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgccccggtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccctggtcctcactaggcctcagtcccggctgtgggaatgcagccaccacaggcacaccaggcagcccagacccagccagcctgcagtgcccaagcccacattctggagcagagcaggctgtgtctgggagagtctgggctccccaccgcccccggcacaccccacccacccctgtccaggccctatgcaggagggtcagagccccccatggggtatggacttagggtctcactcacgcggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgctcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccctgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctccaacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatgcccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcagaacatatgtttgtcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaagagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacctgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaacctgctgccacagccctccctgtggggcaccgccgcgtgccatgttaggattttgactgaggacacagcaccatgggtatggtggctaccgcagcagtgcagcctgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggccggcccacattaccatttgctgccatccggccaacagtcccagaagcccctccctcaaggctgggccacatgtgtggaccctgagagccccccatgtctgagtaggggcaccaggaaggtggggctggccctgtgcactgtcactgcccctgtggtccctggcctgcctggccctgacacctgggcctctcctgggtcatttccaagacagaagacattcccaggacagctggagctgggagtccatcatcctgcctggccatcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccgccagctgcaccagaccccgtcctgacagatgccccgattccaacagccaattcctggggccaggaatcgctgtagacaccagcctccttccaacacctcttgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaagaccactcatggagcccccagccccaggtacagccatagagagagtctctgaggcccctaagaagtagccatgcccagttctgccgggaccctcggccaggctgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccatgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccagggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtcctcgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcacccccaaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccatctgctctcctctcatcaccccatgggaatccagaatccccaggaagccatcaggaagggctgagggaggaagtggggccactgcaccaccaggcaggaggctccgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcccatctctctcacccacggactcacccacctcctctccaccctggccacacgtcgtccacaccatcctaagtcccacctacaccagagccggcacagccagtgcagacagaggctggggtgcaggggggccgccagggcagctttggggagggaaggatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggcaagacccaaaagcccctcagtgagccctccactgcagtcctgggcctgggtagcagcccctcccacagaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccatggcaccctgccatgtcctgcatttctggaagaacaagggcaggctgaagggggtccaggaccaggagatgggtcccctctacccagagaaggagccaggcaggacacaagccccctccccattgaggctgacctgcccagagggtcctgggcccaccccacacaccggggcggaatgtgtgcaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacagtgtccccactggatgggaggacaagggccgggggctccggcgggtcggggcaggggcttgatggcttccttctgccgtggctccagtgcccctggctggagttgacccttctgacaagtgtcctcagagagtcagggatcagtggcacctccctaacatcaaccccacgcagcgcaggcacaaaccccacatccagggccaactccaggaacagagacaccccaataccctgggggaccccaaccctgatgactcccgtcccatctctgtccctcacttggggcctgctgcggggcgagcacctgggagcaaactcaggattaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatggacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgtgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggccacatgtgtggacactgagagccctcatgtctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggccatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcctgccccagagcccaggaggctgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggccaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcaggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccctggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaagaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgcacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggcctggcggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacaattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcctgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcctgccccagagcccaggaggctgcagaggcctctccagggggacactgtgcatgtctggtccctgagcagccccccatgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggtcactgttgtctgtactctgccctctgtggggagggttctctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcaccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacacagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcagcaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggctcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtggctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccgccctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgccgagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccacgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcggcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccagaccatagggacagagaccagccgctaacatcccgagcccctcactggcggccccagaacaccccgtggaaacagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctggggctgaggggctgggggagcatctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctgagcagggccttttgctgtttctgctttcctgtgcagagagttccataaactggtattcaggatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggacaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgactggactcgcagggtttatgcacacttctcggctcggagctctccaggagcacaagagccaggcccgagggtttctgcccagaccctcggcctctagggacacccgggccatcttagccgatgggctggtgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctctcttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggccctctccttatggttcccccacctggctcctgccgggacccttggggtgtggacagaaaggacgcctgcctaattgtcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccactgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcatccaccgacccgcccacctcctctccaccctggccacacgtcgtccacaccatcctgagtcccacctacaccagagccggcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaatggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcttcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagccctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcgcttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaagacaaagaaatttgtttttttgaataaagacaaatttcatcacacgaagataaagatgcaaagctccagacaggaaggcacggacagcacagtgaagcctggagcgggcgctggggggccaggggcatggcgggggtgccagcgtctctcagtgcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgtcgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagagaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagcccagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttgtttttgtttttagacggagttttgctccagcccaggctggagtgcaatggcacaatctcagctcactgcaacttccacctcctgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaaggcatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactagcataaaaacagacacagagacaaacagaacaaaatttaaaaacccagaaataaatccacacacctacagcaaattcatttttgacaaagttgccaagaacatactctggggaatagataatgatatctcttcaataaataatgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttactacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataaaaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccaacctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcccccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagcgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcagggcacctcccctgcccccagacaccctgtgcccatcagttcatccccagcagaggccctcaccaggcacacccccatgctcacacctggccgcaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttctggggggaaataagggtgctgggtctcctgccaagagagccccggagcatcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcaggtaagaatggcctctccaggtctttatttttaatctttgcctatggagttttcagagtattgcatactaaccccggagatgtgtcaagctggccgggagaagctagggactaaactgcctaggggatctcagagccttggggataaactaagaatctctttgatggtgttggtagagtccctaaatgatggagcagggattttggagcctcatttgagggagatgctaaaaagattccatggctaaagggatagtttgggctgtggttggagattttcagtatttagagtaatagtgttagctgagaaatataattcaggaccctctgagacagcatctgtacagtatctgatgcacagggacaaagagtggagtgggacactttcttcagatttgtgaggaatgttctgagtagattgtttaaaacatcatttgttgaaaagagaacttttagtgaatcaatcaaggaaggaaggaaggctcagtctcaaaagggtagctgatatccagaggaatctggataagcctgcaaaagtctagctttcaaaggaatgcagaagtatgcatgtggaaaattagaagatttttttttacccttaaagtggttcctatgatagttagaatactgtgactttactatgtgagagagttttcaagtattcacttttttttttaaatgtccaagtacgaaaaaattttgtcagtttgaagtcaggtttgtacagaattgatattgttgaaagtttaaccaaagaatgggaatgaggctctttcacaccctattcagaactgacttttgacaataataaattaagtttaaaatgtttttaaacaaattgagcaatgttgagttgcagtcaagatggccgatcaggaccaggacacctgcagcagctggcaggaagcaggtcatgtggcaaggctattttgggaagggaaaataaaaccactaggtaaacttctagttgtggtttgaagaagtggttttgaaatgctctgtccagccacgcagaactgaaagtccaggctgagaaaaacaacacctggataatttgcatttctaaaataagttgaggattcagtcgaaactggaaaggtcctcttttaacttagtgagttcaatcttttaattttagcttgagaagttctagtttccctcaaacttaagtttatcgacttctaaaatatattcattttcaaaattaagttatgtaaaaaaattgaaggacttcagtgtctttaatttctaatgtatttagaaaactttttaaagttactttattattcttccctctgattattggtctctgttcaattcttttcccagtacccaaagcatttacagtgactttgttcataattttttttaagttagttgttttctgccttactattaagactttagcattctggtcgaagtggcttcataaatctttttcaaggccactttttaggagaaagacatcttttttttaatgaatgcaattatctagaattatttcagttaaacatgttagttggtggttgagaggacactcagtcagtgcagaaggtctgtaagccagtccacagagacattcctgggtgaactccctctggccctgcttcttgttggagaactggccagaggtctgagaccaggctgctgctgggaaggcctggactttggtctcccagtaccgcccagacctggggatgtatggttgtggcttctgccacccatccacctggctgctcatgaaccagccagtcttgatggctttgaaggaatgattccacacaaagactctggacctccctgaaaccaggcactgcaaacggtaagccagcggcagccacagctgtggccgctgtccttaaaccttgtaattgtttctgcttgattgagtcttaagtcattgctttaggaggagaaagagacatttgtgtcttttgagtaccattgtctgggtcactcgcatttaactttccttgaaaaacttataagagaaaaacgttgcctgttaaccattaactacagggctcgtgatactttgagaaaatcttagaaaaaaatgtatacagttgtctggaattatttcaatgaagtgtattagttggggtactggcgctgtctctacttcagttatacatgtggttttgaattttgaatctattttgtctcttcttaagcaccaagtatagatacagtggatacactcactggtttttaacggtggttttaatctagaaggaatttaaactggaggctaatttagaatcagtaaggagggacccaggctaagaaggcaatcctaggattctgaaagaaaagatggttttagtttttatagaaaacactactaccattcttgatctacaactcaagacggtctaatgaattttgaagttactggtaaatatacttcctggttgttaaggaatgattatcaaatggatcagtgcttggatctgaggtcagtgtgagaggacagggcctgggctgtggatatacagaaggaaggccacagctggatagaattgaaaaagaatggagacctgctgctgaggcaagcagatcagccggactctttccagccatagcaaagaaccagattaataaagagaaggccagattaataaagcttgctgagcaaaatttagtgaacaaggttgacagcctggctaggaagctaggctctagttaagcacagttggactgagatgtgtaggcttccctgagcccttcaaaaatgtgctaagctgagatgattactctgaggtagccaaagctggacttgagcaggaacgaggtagactgcaatgagctgaattgagctaggccggctaagctaaactaggctgacttaaccaagatagccaaattggaatgaattgtcttgatctgggctgattggagctaaactctactggactgctctgaactgagctgtgttgggctgtgttgtgctggggtgagctgagctagcatgagctactctgtggtagctggggtgagctgggatgagctgagctgggtgagctgagctgggtgagctgagctgggttagctgagctggggtgagctggggtaagctggggtgagctgagctgggtgagctgagctgggtgagctgagctgagctgggtgagctggggtaagctggggtgagctgggctgacctgaggtggttgagctgagctgggtgagcagagctgaggtgagctgagctgagctgggtgagcagagctggggtgagctgagctgagctgggctggggtgagctgagctgagctgggtgagctgagctgggtgagttgagctgagctgggtaagctgagctgagctgggtgagcagagctgggggtgagctgagctggatgagctgggctgaactggggtgagctggggtggggtgagctgggtgagctgagctgggctgagctgggctgagctggggtgagctgagctgggatgagctgggctgagctgggctgagctgagctgggctgggctgagctgagctgggctgagctgggctgggctgggctgggctgggctgggctgagctgggctgagctgggctgaactggggtgagctggggtggggtgagctgggtgagctgagctgggctgagctgggctgagctggggtgagctgggtgagctgagctgggctgagctgggctgagctgggctgagctgagctgggctgggctaagctgagctggactgagctgggctgagctgggctgagctgagctgggctgggctgggctgggctgagctgggctgagctgggctgagctgagctgggatgggctgggatgagctgaactgggtgagctgagctggggtgagatgagctgaacagggctgaactggggtgagctgagctgggatgagctggggtgagctgagctgggtgagatgagctgggtgagctgagctgagctgggctgagctgggtgagctgagctgggtgagatgagctggggtgagctgagctggggtgagctgagctgggtgagctgggctgagctgggctgggtgagctgagctgggttgagctgagctgggctgagctgggctgagctgggctgagctgggctgagctgggctgagctgagctgagctgggatgagcagggctgggatgagctgggctgagctgagctgggatgagctgggtgagctgagctggggtgagatgagctggggtgagctgagctggggtgagctgagctgggatgagctaggtgagctgagttggggtgagctgagctggggtgagctgggctgggtgaactaaactagggtgagctgggctgagctgatctggttgagctgggctgggtgagctgagctgggtgaactgagctggggtgagctgaactgagctgggtgagctggggtgagctgagctgagctgggtgaactgagctgagttgagttgggtgagctgagctgggtgagctgaactgagctggactgagctggggtgagctggggtgagctgggctggatgagctgagctgggtgagatgagctgaacagggctgaactggggtgagctgagctgggatgagctggggtgagctgagctgggtgagatgagttggggtgagctgaactgagctggactgagctggggtgagttgggctaggtgagctgaactggggtgagctgagctggggtgagatgagctgaacaggtctgaactgggatgagctgggatgagctggggtgagctggggtgagctgagttgggtgagctgagctgggtgagctgagctggggtgagctgagctgggattagctggctgagctgggatgagctgggtgagctgagttggggtgagctgagctggggtgagctgggctgggtgaactaaactagggtgagctgggctgagctgatctggttgagctgagctggggtgagctgggctgagctgggctgggtgagctgagctgggtgaactgagctggggtgagctgaactgagctgggtgagctggggtgagctggggtgagctgagctgagctgggtgaactgagctgagttgagttgggtgagctgagctgggtgagctgaactgagctggactgagctggggtgagctggggtgagctgggctgggtgagctgagctgggtgagctgagctgggctgagctggggtgagctgagctgagctgggctgggtgagctgagctgggtgagctgagctggggtgagctgagctgagctgggtgagctgggctgagctgagctgagctggggtgagctggggtgagctgggctgggtgagatgagctgtgctgggctgggtgagctgagctgggtgaactgagctgagctgagttgggtgagctgagctgggtgagctgagctgggctgagctggggtgagctgagctgagctggggtgagctggggtgagctgggctgggtgagctgagctgggtgagatgagctgtgctgggctgggtgagctgagctgggtgaactgagctgagctgagttgggtgagctgagttgagtgagctgagttgggtgagctgagctggggtgagctgaactgagctggactgagctggggtgagctgagctggctgagctgagctgggtgagctgagctgagctgagctgagctgagctgagctgggctgagctgggctgggtgagctgggctgagctgggctgggtgagctgggctgagctgggctgggtgagctaagctgggtgagctgggatgggtgagctggcctgagctgggtgagctgagctgaaaggatctgggttggagtcagctttgcttgggtgagctgagcagggtttagctgagctaggatgagttgagttggctgggctgagctgggatgaagtaggctaaataagctagcttgagctaaatagagctggggtgagctgtacttaaatgagctgtgattgaagtgggctgggatgagctcagctgaactgggctagctgatgtggatgatggtgaggctgagttaggatgagcatgactgagctggtttggacatgaatgagctggacccggctgacttgggctggttgagctttgcaagatgatgtggactaaactgggctagctggcaggatgagagaggttgaactaggctcagatgagctaggctgagcagggcttaggtgaggtggtttgggatgagctgggataagttgggctcagatgagctaccatgaactgggctgaggtggcctgggagaacatgaatcgagttgcactgagtacagccaggatgaactgggataaactgggctaaactgggttgggctaagaatggactgcctgagttatgctaagctgagctgggatgaattggggattgtcaagacttaaatgagccagactgaactggttggacttgggtgagctgaggggacctgctgcagggccggcatagctgagttgaatttagatgaggaagggtgagctagactgagcaaggctagactgcttatgctgagctacactaacctggcctgagttgggccaggctttgttggccatgtctaaactgagttaagatcaacagggagtctagaggggtaggggatgaactaagatgaattacactagctgagctgaattgagataaggtatggtaacctgagctgaactggaaagagatgtactggataaccttaactgggctgagatgagctaggtctacccaggcctggatcagcttaattagggtaggctagaccaaactgtagcagtatgtattagcctgtgccaagctgggctacattaaactaaactggacttagctaggctcagattagtttcgctactctagatggggtaagttgggccaaactgggatgaactaatttaactagcctgagatgggcagatctgaagtgtagcaaacacagccagggtgaactgaatgagtttgaccaggcctggaccagttaggctaaggaccttgtcctgggcagaccgtgtgctatggtggagtttcatgatgatgccataagagttcccccaccataacccacgtttctcctaccccatatacctgtctggtgtgtaaacctaatctttgtgtgctgatacagaagcctgagcccatcccccttccaccaccacctacctattgctttggaatgagcaaggttatctcagcgaatgtctcaaagggaagccgggacctaggcctgtccctgagagcagatgttcatgcccctggagtggctgccggtggctgaagggccagaaccacctactctagaggcatctctcgctgtctgtgaagtcttccaaagacattcctgtggttagaaggcagccctgctgtggctctgtcccatagaccaaacttacctactatctagtcctgccaaccttaagagcagcaacatggagacagcagagtgtagagagatctcctgactggcaggaggcaagaagatggattcttactcgtccatttctcttttatccctctctggtcctcagagagtcagtcctccccaactgtcttccccctcgtctcctgcgagagccccctgtctgatgagaatttggtggccatgggctgcctggcccgggacttcctgcccagctccatttccttctcctggaactaccagaacaacactgaagtcatgcagggtgtcagaaccttcccaacactgaggacaggggacaaatacacagctacctcgcaggtgttactgtccgccaaaaatgtccttgaaggttcagatgaatacttggtatgcaaaatccaccatggcaacaaaaacaaagatctgcatgtgccgattccaggtaagaaccaacccttcccgaggggatggggagagggggcaggcccaggcatggcccagagggagcagtggagtgggtcttaagccagcctgagctcacacctcaacctttcattccagctgtcgttgagatgaaccccaatgtgagtgtgttcattccaccacgtgatgccttctctggccctgcaccccgcaagtccagactcatctgcgaggccaccaacttcagtcccaaacagatcacagtatcctggctacaggatgggaagcctgtgaaatctggcttcaccacagagccagtgactgtcgaggccaaaggatccagaccccaaacctacaaggtcataagcacactgaccatcactgaaagcgactggctgaacctgaatgtgttcacctgccgcgtggatcacaggggtctcaccttctggaagaacgtgtcctccacatgcgctgccagtgagtagcctgtgctaagcccaatgcctagccctcccacattagagcagtcctcctacggttgtggccaatgccacccagacatggtcatttgcttcttgagccttggcttccaacagtggccaaggccaaggatgagcagtaggcagcagggggatgagagtcagatggagggaatcagcatcttcccttaagcagatttggaagatggagactgagcttttatccaacttcacaactagacacatcacaacctaacacagtgttctcttgactgcaggtccatctacagacatcctagccttccccatccccccctcctttgctgacatcttcctcaccaagtctgctaagctgtcctgtctggtcacaaacctggcaacctatgacaccctgaatatctcctggtcttccaaaagtggtgaaccactggagaccaacactaaaatcatggaaagtcaccccaatggcaccttcagtgctgtgggtgtggctagtgtttgtatggaagactgggataacaggaaggaatttgtatgcactgtgactcacagggacctgccttcaccacagaaaaaattcatctcaaaacccaatggtaggtatccccctttccttcccctccaattccagagcataccctgtacctcacagggagggcaggtccccttctaccctatcctcactattatctttgcttacagaggtggccaaacatccacctgctgtgtacctgctgccgccagcccgtgaacaactgatcctgagggagtcggccacagtcacctgcctggtgaagggtttctctcctgcagacatctttgtacagtggcttcagagagggcaacccttgtcctcagacaagtatgtgaccagtgccccaatgccagagcctggggctccaggcctgtacttcacccacagcatcctgactgtgacagaggaggaatggaactccggagagacctacacctgtgttgtaggccacgaggccctgccacacatggtgaccgagaggaccgtggacaagtccactggtaaacccacactgtacaatgtatcgctgatcatgtctgacacaggtggcacctgctattgaccatgctagcgctcaaccaggcaggccctgggggtcgagttgctctgtgtatgcaaactaaccatgtcagagtgagatgttgcattttataaaaattagaaataaaaaaaaatccattcaaatgtcactggttttgattgtccgatgctcatgcctgctggggcaactgttgtgttatgcttgtcctgcacacaccctgtatacttgcctccaccttggcccttcctctaccttgccagttacatccttgtgtgtgaactcagaaaggcttacaacagagtgtgagcatgccattcctccagctacttctagatatggctgaaagcttgcctaccttggtgcaggcagcattcaggcacatccacagacacacagagacagacatgcatttatacatagatctagagatggacatgtatagatacatgcacgaatatgtattcatagacacacagatagaggttccgcatgcgtgcatggacaaatacaaacaccttcagagacaaatatgcacagacacacaaccacacatggaaacaggcacaaacacacatgatcatgtgtgcaccaaaacagaatataggcaaatatagacaagtgaactacatagacatgaagacatgcatacacagacatgtaaagaaacatcttgaaatgtgtacactaacatgtggacagacatggcacacagttacacctggtctctgaccaggaccataatctccagggttcagggctcagagagtccatactaggctgggtggcactgatactcctcagggtcccactctatgattaggggaaatagcccgaggagcaaaatgtgcatttttggctcaacaccatggggcagaagataccccactaaccacccatgacagaaaattagccttggttgtgtctccattaatagaatacctcaggagatcaatgagagagcgcttgacccactcacttcccagtccagatgcagaagacacaatgcaattgtccaaaagaattgtacacacacacacacacacacacacacacacacacacacaccaacaaaggaacctctataaggagtcaccacccaataacattgcctctttggattcacatcctggacattcttcatattcatatccatttgggacctgggctttagaaatccccaagggctcatctttacagaggtcagagatcccaataaatgccctggtcccacagcctctctatctcttggtaccaagactcaacactgctggcaggggtagaacaatcaacacacaggaactctgatcaaagagaggcatgagatgcctgggtccttcaggaagtaaggagggataacctctgatatgcctactcttattcccaaagcccaggagaagggaaacctgctctgaattctcagtctaacagccccgatggtgccacctgctcagagaaagtccaaagaacacaaaaatcattatgccacatttcctgagtctgcctttacccatgtccgtatgttgcatctgccttgcttgctctgctgccccagagttcctgggacaaggccccaagttagtgcctcctccagtttgacctgtgctttgtctctgtctagcttgagctattaggggggccagtcaattctccagaaccagcagaacacccccaaccctgaggcaaatgttcaatcaccccaaggcttggcttgaccctccctctgtgtgtcccttcacagagggggaggtgaatgctgaggaggaaggctttgagaacctatggaccaccgcctctaccttcatcgtcctcttcctcttgagcctcttctacagcaccactgtcaccctgttcaaggtagtgtgtgtggtggggctgaggacacagggcagagacagggagtcaccactcctcactgcccctacctctactctgtaaaagggaacagcaattcacactgtctctgtcacctgcaggtgaaatgactctcagcatggaaggacatcagagagcaagagaccctcccacagggacactacctctgggcctggggttcctgcctgtatgactagtaaacttattcccacatctttcctgtgttgccctccagctttgatctctgagacgggcttctttctagactggccaaagactttgtccacttgtgcaacctggaacaatgtctggaaccacagacagctgtgctgtatacaaatgtcactttgaaataaatacttcaccttgcgaacccactctattgtgaaggaatttgttcttgttttcaaacttttcctgtggtgttgacatcccaaagactctctaaatagagcctgggaacttgaagtgaacagtctgatggggcttaagagtgaaagagggaaaggaggtgtggaagaagagagagagagagagagagagagagagagagagagagagagagagagagaaaccaccctgacagcaaagtatagcacaggcagccaatgggtagcagtctggtttatccaccctgatagaagaaagtagggcagagaaaactccaggcctgatctcacaaaagcaaccgaatctgaaaagtagcctctagcctggggtgtctgctccatccctcagcccaccctcttgggctggcgttgcttccagctagtgcaatactttggtgttagccaaacctttgtggtatgtggggtgtgccttgggagagttggctgagatctctaggatgtttgtatcccttctgcaacatgacaagccctaggggttagcccataacttgaggactcaaaccctctgtctataacaactgctgtggtcactggagaaggacagctaaaggcctgctcacacagcaggaaaggaaagggaggtaggtcatgtacttcagctcagaggaggaagcacagcagatacaaggtgagggcagtgctaggggttctgctgttcaccgtgtggatggctggaggaacctcacagaggtgggactagctggttacattgagagcaggacctgggagcagggcataagaaagaatatcagacagtgggagggaactgtgtagatgccagggtcctaaagagagtctttaaataagcatgtatggtagcaccttggtgatggcccctttctgagttgggtttctagtgggtagctgcaggagagcaacaagcatctattgagaaaacactgtaaagacgatagggcccaccaccaaattccagatatattttaggcattcacctcaataccctactttccataccagcatctgttttagtttccctgggctgcgggtgcaaagtgccacatgtggcagtttgagcaacagaactctgttctttcccagttctaaaggccaggattctgggcttcagcaggctggttcctctgtgcggcagggagaatgtgtcacagacttccagctctgaagccatagcatttgactaatacttgtctcctggcaccaacaccccagttactgtttcaaatgcatagcccatccccatgtgtgtttcctttgtacttactgccacgtttcacgaacccagttctgctgggtttgatgcccaccctcattcagcacaagttcatctcaggcagattccacccactacgacctcagagctagaagtctatgacacgttctccctgctgcacagaggacactagcctgctgtagcccagactcctggcctctagaactgtgaaagaacagagttctgttactcaaactgccacgtgttgcactttgccccagcagcccaagagagctacatagatgttagtatatgacgtaaggtgcagaggtgactttggaattgggcgatgaacctccaggcagtaaacagcctgctgacctttgcattagctgtgtgactgagatcacatcagttcccgacccccaagccccttcagacgtcacatcaatagagtcaaccgttagagtccatcgctataggaatgatgtcgcttgcactttagaaaggttttataaccaggactgtagttgtaccttaagctttgtgatatgtaaagaagtgagctaattatcaaaaggaaacattctgccaagtgatgttgtacttgaatgtgcccaaaacaaacatcccagcatcaaacgctagtatcttaaaccaacacaggtactgagtcatattaaactgaacgtacttcttgattcacacagacctacactgctgtctctgtttgcggagacccatgcagactaggtactggtgcacatagtcaacgagatgctgagggaggagagcacatactttaaggtagattaaaagggcactggacttggctattgacctccaggccacgctcaatgatgaggcaactaagagtctctgtacagccagaaatgtccccatatgctggccaggtataagatagatggtactagacacttggtgcaagagaaagagagtgtatatgacagacataggcacttgtagacttagtacacagcccactcagggccctaactgtctaaaaatgtgaaggagaatccataactcagtccatgagcattacatacacacctgtagctccacccacctcatcttcacaccttttaacatacagatcatcaggttatatcaggcctgtggcactctgaacccatctccatggctagtctatatccagaatgctgatggaccagcggtcaaggaagcctctctacctaccactctgatgccttttcctcctgagcttcatggtcaaagagaggatccatgagagcatccagggaccaaccacagccctatcagcacatggttctccagccatgtcgtcaactctgtctacccttggttattgctctttaataggtaccttgtctcactgtggcttataggttccatacgtgactatgatatgatagttcttcatctcaggtcctctgagtatcaacattctcacagacctagagcctgcctttgctctgaaagctgtatcttctcaacttggcactgacacagacagcaccctccattcctgtgtattgacccacatcctacccggagatattcctcaagaagcctcctccttaacctatgttcttccccggccagcacaagctcctaaatctgtgtcctgggtctgagccttggacctcataacgtggatcttctgtttacagaggttcaccccagcatcctacactacaattacccagcatgggcacctctgaccagacataaccttcctgattaacaatctgcttcttgttctccacattgcagtctttctgatgaggcccacataacctacaggctcctcacctctttctctgacacttcacaacacattcttccttcccttccattacatactgtcagtgtctctaaacccagagaaacacctggcttttcctagcagtcccaatcattcaagttaaggaccctcactttagtgaggatggccagtcccatgacccttcagaatttgttcccatctacatagttctgaggccctgaaggtcaccctctcccaatatctgtacctaactcctcctgcaaagacctgcaatgagctcctctactctgggggatccactaacctgtgtatcatgtgccagagcaggtttgattacttcattccgtattctcatgagcccctgagaccagaactggaatccctgattccacaatctaaaccatcaggttcccatggcagtccattttagagaccttctggtccgtgcctcttcttaatttatccaaggcattctcctgagtctcagcaatgcttctgtctgaagacataatttcctctacttggacactcaggcagagactcgagcctcttctttaaccgattcagtttggatggcacaccaggcttatcagtgttttcttgagatagcactagctagagacagggacagagaggtttagccaccaaagctggacttagatcacacatgaacaagaggcccagaggctatgaaccctctccaatgagctggtcaggaaagagtgggcataatcactcagcctcagccagctcagggacccagaaggcccaggtgcacagagtaggagcacatccaggcttcctaccttgtcccctgagtctcaagagtaccacatcaactactcccacacatccacatgaactaatctcagtcagctttggactccccctcatgtccagatacagaaacctccccagaataaaggggaacctcaggaaataccttatgccacccactgtcaatcatgttcttactcaatcatagggtggaaatagggtggcattcgcatctctggaacaaaggctgtgactctgggaaagacaagagaaagccaggaacaaatacatctgctttcacagcttccacatgtcaaaggggtcagcactaaatgaagctgcagaagaagaagacctcacagacagccagcatctgtagcccttccagatctttgagtcatcctatcacaggagattgagaaggagttgacggaccagcccaagcagaggaagcctgtgtgttcaacagtaaatgtgtttgccagcagcctgatgtcaactgagaagactgtggcgagtgcttgggagacaatcacgggcagctagagctgcacaaccccatagacaacaagcctgaaacacaaggagatgatgaaatatatccagaagactgcggaatcagtttggcctggaccacaggttgatagaaccaaggcagctgagccctgtggtaagtgaccaggagggcagagggagggagcttccaggagcatgcctgggaatgccttcaggccttctgagaagcagaaagtaggcaccctggggttccaggaaccatcccagcactcaagagttactaagggaatagaagcaaacctgagctgaaggagagaaagaaaagtggagggaagcccaagccactcaaagtaacaggcaggacaacttccagtgagctgagagaacaggagtgctggagaaggcagagcaagcccagcagatcaggagaacctgcataggagtctggatgactagagaaacccagaaggtgagagaacaggcttaacagctgtcatggacttagggatatgcaagcctggggcaccaagctgatctgcatagagggcaagggtaagtgggaatccaagagatctaagaatgaccagcgctgggcagagaggtggcctgggagaagatggctggtcttccccatgagtccaatagcaagattgtcggaataggttatcctatgacagatggcagtatcagtgaccaaatgaagacgctatggaagaattggaccatgtgggagttaagagttgaggacacaaggctgacctgcccatgggaactacagctgataaaagtgctgtgattcagggcatttctggaagctctgtgatccaggttgcagtacacaagtaaactgggacagacgggagttctgggggttcagttcagatactaggaacttaggaaactgggaaaagggaagttggggctgatggcagaactatgagaaggcactggaattctgaagaccagaccttctaatcaactatagaggaaatggagtgggtaggagtggtggatacagctgagcatcacaggggacctggggattggggacagctatactggggctagcagtgcaaacacagaaattgggggaccaaagggggaattgaggatgaccttgggtagatagaaatgctggatgcctaaggtacctccaggagcttagggaacctcgcagagcagctacaaagctggtggtgttagtgacactttcagaaccagatcgggcaggttggcatgtagaaatggggttaatggagacccaggacagtggcagattcagaataaaatacaaacaaccgaaagagttatgtgccctgtaagaagttgatctgacacccacagcagagacatctaaggtctcacagcccacatcaaacaggcttctgatctaaggacagcacaaaaggaaggaggcatcaaaccatcctggggaagacagtgcagtagtagccagaagtgtaagcccaacagcagtgggactggtgtagcagccagggacagggtccctgccaagatgagcctcaggggagctgagcagctgagaaactcaccagctgagaagctcaggggaatcagggtaagtggaggttccagagaatcaggggaagtcaagagctcagaacccaagaaggggcacctgcaaaagagctaaggcctatgagagtgtggggaacactttaagcagctttaggggagccaagacaggtagaagtgtggggacccaaacagggaagctccaggggagctaggaaaggtggaactgtgggaatccaggcagagcagcacctggggagcaaggaaagaagtgtggggatccaggcagagcaggtccaggggagccaaaaagtggaggtgtggagacacaagcagggcagcatctggggaaccaggacaggtggaagggtagggacccaggcagagcagcaccaggggagccaggacaggtggaactgtggggatccaggcagagtagcaccaggggaccaaggaaagaataagtgtggggatctaggcagaacaggtccagaggagtcaaaaagtagaagtgtggagagccaagcagggcagcatctggggagccaggacaggtggaagtgtggggatccaaccagagcagcaccaggggagccaggaaaggtggtagtgtagggtcacaggcagagtcgaaccagggaaccaaagaaagaagaagtggggggaccaggggagccaggacaggtagaagggtggggacccagacagagcagctccaggggagccaggacaggtggaagggtagggatccaggcagagcagcaccagggaagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaataccagggaagccaagacaggtagaagtgtggggacccagacagagcagctccaggggagccaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaagggtggggaccaaggcagagcagctccaggggagccaggacaggtggaagtgtagggacccaggcagagcagcaccaggaaagccaggacaggtggaagggtagggatccaggcagagcagcaccaggggagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaatgccagggaagccaagacaggtagaagtgtggggacccagacagagcagctccaggggagctaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaggtgtggggacccaggcagggcaccaccaatggccaacaaggtagaagtgtggggacccaggcagagcagctccatgggagccaggacaggtggaggtgtggggaccaaggcagagcagctccaggggaggcaggacaggtggaagggtggggacccaggcagagcagctccaggggagccaggacaggtggaagtgtggggacccaggcagagcagctccaggggagccaggacaggtggaagggtggggacccagacagagcagcaccaggagtgtcaggagaggtggaagttaagtagttataggggaacaggggcagaatagaatgagggatgcaggctgagaggatacaggggaaatgtggcaagtggaagggcaggaagagaggcagagtggctacagggaagttgaggcaggtaagactgtctgttccaggtcaaaaaacactgaagaccagtagaaaggaaactggtgcatgtggtagtgggggattcttagcttagcagtcacagggaaagtgagccaagtaggaatgcaggcatggggggcaggcacagctgagcaaacactaaagagctgtagctgaagggttataaggtaccaagctgagaagctgctgggaatctggagctaatggggtgtgggggagcaggctgagcaactacacaggatcagggataggtaactgtgtaaggaggcaggctgagcatctccatgacagctggagctactatgaatgttaagctccagactgagcatctgcagggaaacagaggcaagagggagtgtggggatccaggctgagtaggtccagggaagctgtagtaggtggaggtggaggcccaggctgaggagctacaggagagatgggacactagggagggcagggatcatggccaagcagatactcagtagctgagatagatgtggggaatcagcttaagcagcagacacaggggagcaggatctagtcagcttctagggatccaggctgtgtagacatggagggactgggggagctataagtaaatacactaggcataaaattacagggaaacggaggccagtgggaacgtgggcctcctactgaacaagtaacagagagccagaactgacgggttgaagaggaaccaggctgatgagctccaggaaatctgtggggactcggtcaatgggagaacagggtgagcagctatagaggatcagggataggcaaaaacgtatggagtcaggctgagcagttacatgagagctggagccctagttatgtggaggtccaggcagaggggctggagggtagctgagggaaatggtgctagagaatcaggctaggcagacacaggggagcaggttctagtctacatatgagtggggatccaggatgtgtagagaaaggatagcaaaggtcatggaggattccaggcttaggggtcactgggaaactaagactggtggaagtgggattgtcctaagtgaacaaattccatgaagctagagccagtgggtgtaaaggtagcagactgaaggactatagagtatctgggggtggatgggaatgtggggaatcgtgctgagccactacaaggacagtgtggctagcaggctgtaggagaccaagctgagtatctgaagggaaaccaagggaagtggaagtgtaggattccagaaatgagcaaatgcagggcacttgaggcaggtatcagtgtagggaacgagactgagcagttcacaggtcacccagggtaggtaagagttctggatcatcagagaagcctctggaagccctaagcacctacagtagacctaaggcaggtggggtgcagggaataagttgtgcagctcctgaggaggaggacaggttggagtagaggaggttctgactaaagagttgaatgggagcagggcaggtgggaatgtagaggaactagctagacagaagtccagatgagattgagggccacatgatgccctgagccgatgagctggccttagaaatcactctgctgggaccagggccaggggtttgaggaacaaggctgaggtgaaatggtagcatgacagggaggcaatggcagagaggaaggagaaggcatgcttaattcatggtggagtgcagggagggaaagagccaggaggtctaggctggagctgatccagctttctgcactgatgagaggggcgggactgagttcttttggctccaggagccagggcaacaagacaaaggcgcctagcatagcaaggacacatctggatctaagaccaggagaagagggcaagaccgaaagttcaggaggtcatgggagggagtgggaaatctacaagggactgtctttagaaaagagtaagtgcccagtggagggagtgcccaagcaacaagtccagtgttgggagagatcggggtgggcaaaggctgtatgtgcagtaggcaggcccaagtccccaggaaggaaagaagaagtgcataggaaaacgggtcaggtctagcaggagccaaccgaggtgctcaggactgagaggcagagcccaagacacaggaatcgctgagctcatgcaggtaccaagaataactgagagctaagagaaaaattatctagggaatagggggacatgaggaaggactgttggctgagaagggaaagggacagggagaatcctaagggttggcatagacaaaggaaacacacaggctttgggttgttagtccggggctctgcatatgatccaccgagattgtggaaacagaagagcaggaagatcaaatctgtcccaactatacagggacacacggtcaacctacaaaaggaaggagatgtgaggatcaggggctgagcagtgaggaggtgtgtggaggtgttagagctcaggtgcagcagagactagcatggccctggggatagagggaaggacccaagggacagtagggacaggagggcgaggtgaggtgatgaccagcattatacaaatggtggcgctgtccaacttctagggccctgtgctactgagaaaggaaagggacttccgaggtttggcaatacaagccccgtgcaaaggcagaacccagggcactgtgaagacaacactgcaagacaggagaagccaaggctgagttcaccgaggtcacattagtgagaatacactgcgaggagaggggaggcgctgagcacccagccacaccagacaggcccatgctgagtccctggacagtgggggaggggagcacctggtgacctgtaagaactgtgagactggaggagaaccaaggtaaaaggtgtgtcaaaggacacatgtttagcaggctgggccgacttaatgcaggacacacgtggtggcaaagccaagagggctgcgtatgagccacaagtgaatcctgacccaagaatagagagtgctaaacctacttacatcaaagccaactgaaaggacaaggccagcaaaacgaagctaaggccagagatcttggactatgaagagttcagagaacctaggatcaggaaccattagtgaacagacaaaggcaggtaaagcagcctaggagtggacaaagacaggagaatacagaagacggcagggatgacccgacttcagtttgggcttcactgttgtccaaactgtgtgcagattatggcccatgggtaagaggtttagcattagaacacagatacccacattggacaatggtgggggaacacagatacccatactgcaaggctcttcgggccctttcctaaaagtgtactaggagtgggactgggctcaaagggattaggtgtgatctggcctggtgaggctgacactgacaagcccaatggttgggtgttgcatcctccatttatacagccagggacttggggagggtacaaaatggaggacttgtaggagcttgggtccagacctgtcagacaaaatgatcacgcatactttttcttgtagctgaaacaacagccccatctgtctatccactggctcctggaactgctctcaaaagtaactccatggtgaccctgggatgcctggtcaagggctatttccctgagccagtcaccgtgacctggaactctggagccctgtccagcggtgtgcacaccttcccagctgtcctgcagtctgggctctacactctcaccagctcagtgactgtaccctccagcacctggcccagccagaccgtcacctgcaacgtagcccacccggccagcagcaccaaggtggacaagaaaattggtgagagaacaaccaggggacgaggggctcactagaggtgaggataaggcattagactgcctacaccaaccagggtgggcagacatcaccagggagggggcctcagcccgggagaccaaacattctcctttgtctcccttctggagatttctatgtcctttacacccatttattaatattctgggtaagatgcccttgcatcatgacatacagaggcagactagagtatcaacctgcaaaaggtcatacccaggaacaacctgccatgatcccacaccagaaccaacctggtgccttctaacctatagacaccaataacacacagccttctctctgcagtgcccagaaactgtggaggtgattgcaagccttgtatatgtacaggtaagttactaggccttaaattccagccccaggtccaacaaatgtcctctgaggcccatgttggaggatattggcatatttccacctttcttcttcatctacaggctcagaagtatcatctgtcttcatcttccccccaaagcccaaagatgtgctcaccatcactctgactcctaaggtcacgtgtgttgtggtagacattagccaggacgatcccgaggtccatttcagctggtttgtagatgacgtggaagtccacacagctcagactcgaccaccagaggagcagttcaacagcactttccgctcagtcagtgaactccccatcctgcaccaggactggctcaatggcaggacgttcagatgcaaggtcaccagtgcagctttcccatcccccatcgagaaaaccatctccaaacccgaaggtgggagctgcagggtgtgtggtgtagaagctgcagtaggccatagacagagcttgacttaactagacttctgccctcttactgacctccatgctgaccactctctgtatccacaggcagaacacaagttccgcatgtatacaccatgtcacctaccaaggaagagatgacccagaatgaagtcagtatcacctgcatggtaaaaggcttctatcccccagacatttatgtggagtggcagatgaacgggcagccacaggaaaactacaagaacactccacctacgatggacacagatgggagttacttcctctacagcaagctcaatgtgaagaaggaaaaatggcagcagggaaacacgttcacgtgttctgtgctgcatgaaggcctgcacaaccaccatactgagaagagtctctcccactctccgggtaaatgaccccagagtcagtggcccctcttggcctaaaggatgccaaaacctacctctaccacctttctctgtgtaaataaagcacccagctctgccttgggaccctgcaaaaatgtcctggttctttctgagatacagagtccagcgaggtcatgggctgaggggcgtccagggtttgaggcctgaggtttgactaaggaaaaagggtgatctacactgccagacacagcacttttgatttgctggcatgaacagaatttacctctcactgaaaagtggaggctttatcccgaggcaatccctcttgctttctcttcctctacctaatacatctatagtgggcacagaatatatcatgaaagtaaggacgacccaaactccacctccctagtccacctttacccctcttcctagccaaggatcccactgaaggcactcaatggacacatatggtcacagacagacccttgctattccaccactcaatgcaagaagcgttccagagactaagtctaatgtaacgatgcacatagctgtcactgctctctcactgcccatgagaatcaacatggacccattagacacaacctgatgagcaacactgagggcaaaaggcccatatgtatgcatgcacacacatcttcaaatgcacagcacagtgacacacacacacacacacacacacacacacacacacacacacactggaacctcacatgggcatcctgtgcagtactcccagatgaaaagaaaccaggtctacacacaggatcatcccaacattcacaagtgggccagctgagacagatacaacttttctctgccttggatgcccacagacatcttcatgcacacatgagtttcctggggtcaatctgtccctgaccctgggatggtgccccaacctcacacagttggcacccatccgaaactgtataacttactcacttcccactgtggatcttaactgcagtcctagcatcatggggaatcagctctgcaatccctctggccctcagttctcggtcatcagcagatacaggatcaggcagaccacacagacactacccatgagaggcacaggccctgactcagcctagccaggttcagaactcaaggctggagcacacacagaatgacctagtgtataggccaggccaccatcaggtccagggtgtctggtgagctcagggacaaaactacagcactttggggaactgaagtttctggtccagagagagatcagaaaggagagatggcctcagggagggtctgctggcccagtcaggctgtaactttctcctggaactccacacaacctcatctgacacagggaatggccctagtcacgccgtgttgggataaacaaacgctgacttccctctctgtccagggatggaagtggacgatgcctgtgctgaggcccaggacggggagctggacgggctctggacaaccatcaccatcttcatcagcctcttcctgctcagcgtgtgctacagtgcagctgtcacactcttcaaggtcagccacaccatctccacagtgtccacaccatcctcacactgttcctcatactgtctctgtgatcagctatgccccacactgtcccatgctattgacctgtcttacatgctgggcaatgccacctaaccttctctatgatacagtctcacagtgtcccatgcagtctccctaattccccaagatgtccgcactctattgctgtgttgcctcatgctgcccccacactgtccatccctccctggtatgctatcccaggctgttgtctctattttcatgctctcctcacactgtccctagtgtctcatactgccaatgttggctcccacattgtccccacactctgcacacaaccggacaataaaccctgctgtcccataatgttccctgtggtccccaactctatccctgcacatttgtctatgttccctgaattctcatgttgtttgcacactgttagtgtctaacgaactctctcccaggtgtaccttcttccatgctgtctcacctcatctcccattctgtccttgtactaaccccactctatcacgacactgtccctattcactgtccctatgaagtgcccatgctgtctgcattctgtcccatgttgtatcctcatcccggtctcatgcagttcagatctatctgacactattcccactctatgcacacatttccccctataccatccctgtctgatcaacatgcaatcctctagacacccatgtagcaggttagagactctagggatgggtacctgcctgactgagctacctctcttggtgggagaggaaacacaggtgagagtgcagtcctgatcttatcttattcaccctgtcccacaggtaaagtggatcttctcctcagtggtagggttgaagcagacgctggttcctgaatacaagaacatgattggacaagggccctaagccacctcctataatggcaaaggattccccacgccctagaggaccctgtccaatgtgccaagcagtctgactcagatcacactgtctgctcacttcactatcttctgtctatgagacccaacctccctcaattcttctctctctggaggactatgtggacattagatttccacaagccacagcctccaggacctaaaataccatcacagcagcagccaggacactagatagggtcagaaggaccatagtttcctgactagtttatccaatctgttgggacagaagaatcactgaaaaagtgacaagtgcccaagttgcctgtgttcagcttggaagggaccaaccttggaaccagtcctgtcagcatcatcttctaaaacacaagaattgagtatgtaaatggcagattttggatccccagggtaagacagacttcaaccaggccacgacctgggcaatcatggcccagctgaagttgactgaattattccagtggccttcacatcgtcttgccaggttccttcttaccacttccatgaaccctgggatacagaaaagaactgtgcttctcgggatcttgggacagaactgtctaattggtgggatccttaggtagatctttcttccagtcacgggtataatacaatacactagattctcacataaaggaaaaaattcacacacaactccggccagtcctgaggcctagacaccaccacctctctggaattctgagctctatgctggaggcacaagagaggaaggcctggacttcatggcctctgtgtagccctagtaggtgcagaggcccctaagccggggttgggtgaccagcaaggacctcctggagagggatctgatgagtagattccacctgggacagaaggaaaaagatgaaaagcaacagaggtggaagggcactggagagagccatggtatagcaggtttatcttgcagacctgacatctgtccatgactctgagacttagctaatgacagctggggcagcagtccaaggaattaccatgccccctaacaccaggctcctggagtgtggagtgggtctactccagagctccaatacctgtttctccatcacttctcagccaatgagaaatcggtttccagacaggaagaaaaatgaaggcaggaaggaaaagtgggcacctgttcttctgtgagtggcaggaagttctcaaaagactcaggactttggcttctaacttcctgtggatcattgatgtctctaaggtctctgtctgctttgttggttttgtttgtttttggtttggtttttttttttttttttttggtcaataaaacgttttttcaaacattccacaatctctgtgttcttcctatgtgaaccagccctggtacttagaaacagcactgttaagtagaccagtgagtcatgaagaacatactacctctcctggtcctgtgtcctaccagttctcctctaagggtcccttcacagctgtgtgccagctctgctatcctataccagataggtcctccgtctttcttccctatgggcagtttcttcccagccagaagctgcctttgtcctgtaggttgcccactcatggcctcccacaccagccacacaaactaagaagcaggtgtctcagtgacctcaggctcagtgataacatttctatggaaaagtgaaggaataagaaagagaagaaatactccagagtcagggaagagaaagattataagggatgtttgctttctcaagtatgtttggagaagttccagatcaggcgttgacaaggtcgggttctcagcagggctcttcttgcctggtaggtgccttctcctccttgtgacctcacaggctttccctctgtgtgtgtctctgtcttgatctcttctcataagtacacagtcaggctagaagaggtacaccctagccctaattataacttatcagtttatgaccctgtctgcaaacataggtcatggtggcttaaatgtcatttgctgaatcttctggggacagaatttagtccacatcagctctccctatggaccccaaaagttcatatccttcccacatataatgtccctcaccccatacaaacaccccaaagtctcacccttccaccatcagctctgtctcaattctcctccaagactgctagttaggtaagtgtgagatgtgggtgtgactcattcaggatcaagttcaagccatgactgtcaggaaagaggtttaggccgtcagcgcagagcagattccaggaccatctgagcagttgctgaggttcaaaggcagattatagactgattccttgctatagagaagatagcccattgtgatcctctcatactagttcagtgataacaattctatggaaagtgaaataataagaaagagaagaaatactcgagtcagggaagaaaaagaacctgcaggggctgccaattgtctcttgttctgctgggcgtgtctgtgccctactagagttggattctgtcttcccatggagacaaggagacaccggctccatggcctgagatagcaccgtagaggggcccagaatttgcttctggaatgtaggagtgttagcaccaatggagagctaaggtacacaaaggcctcctaagcaaagacccaaaaacaggagctaggtgctaagtgtgcagttgagttctcagatggtgtttagatgtcctcaggtatatccttgactgttagagactgttcaagccattatgacctctagtgatggctatatgagggaaatcaactgggctggactggtcaagagaagatcctgtcaccacagctacagtggtgaggggctgggtggggggcagaatccaaactggccaatgccattacagtttctggtatagggaaagacatgcttttcctcggacagagaagcagcagatccctgtgagtggtattgctgctggggaagccatagggagatggacctcggagggatttgttgctcatgtgcagacagctgcaaggagcctgggctttggccaagcacactgggcagccgctacaatgctacacactttgggagttaggacagtggaacctagactacaaagaggacagctgcactaaccctgagaaaagttacttaattcttcacaaacctctgtttaatgtgtgaccaaacatccctccctgcaaagcgagggaagaagaacatagaatagtgaatttaaagaacatttaggcctgggacagtttccttgctcagataagaggaaatgtttgttttatctcatagttcaagtgtacagtctgtcacagcaagagtcttagtttcatttctgttgcaatgataaagtaccctgaaaatagcaactttattcagcctgctgtttaaggttacagtctatcaccgtgaaaagtgagagcaggaacttgaggcagccagtcattcacacaatcaggaacagagagaggggtgtgcacgtgcccactacccagtgacacgtgacgttagaaaggaaatttggtggggataaaagaggaaatggaggagagggagtagggacggattttatatattacatgtattatgaaattccctaacaataaagagagctacaaacggctcattaggagaaggtacaatgtgtgaagctcttcagtgggttatgaagtagggatggtgaagcccaggtgcactgaaaatgaatttaccccagaagccgcccttcatatgtgcaccatgacatgtgcacgcacacacatgtacacaattatacatagacacattcaacataaacacaacatacatgtacatacaccacaacaccacacacacacacacacacacacacacacgaaacacatacataaacacacacaatcattcatggacacactcaacataaatacaacacaccacatgccctcatacataccacacatacacacacacatgcacacacacacacacaaaacacatcaatacatgcaccaccacacacataccacacacacaccttcatatacaccactcagcacacacagagacacaaaaaaaatacatatttacacaccacacacacatacataaacacacacaatcatgcatggacacactcaacataaatacaacacaccacatacactcatacataccacacacacacacacacacatacaaaacacataaatacatgcaccaccacacacacataccccccaacacacacacacacacacacacacacacacacactagaacacactaatataataatgtttaaggactgcatcatttttctatctttctgcaggcacttgtctgaggtgctgaatgttttcatgctcccatccttgccaaacagcactttatgaggagttataaccatgccacagcctcagtgtggtgctgacttaaaagttcctccaccaaataaactattccattccttccgaaaatagccagatactttcccagaatgtaatacaggtcatcaggtcttgatgagatcttgtctccccaccctgaaacctcatgagctggatccttgctgtccttaccccctttttaatgttccctgcactgggctttctcgtcccacagcatccatgtaagttatcctgaaagatgccacatcctttcctctgctgacaaatctgtccaccttactgtttaagttcctagagtaggtatattctgagaaagtacttatttatatccagagaatatatacatttcacatagttccttttgttctggttattgatgtcattgggtcctgaagttgtgtttggaccttacaatgacaaaaacccatctttccctttcttttaccaccaattctatctcatctatctccctgtttctctctgtccatatctctgtctttttctctgtgtgtgtgtttctgtgtgtgtgtttgtgtttctctctctctctctctctctctctctctctctctctctctctctctctgtgtgtgtgtgtgtgagagagagagagggggggggggagacatgtgtgtaggtgcgagtgaaggtcagaaaaggcatctgatccctgaaacgagaattacaggaggttgagaaccacctgaccagttacagagaaccaaaatcagggtcctgtacaagagcaatatgctctcttaactgccccgacatctctccagcaccccagctttcttctgaggtcttgtatgtcatacataatgaactcagatagggcacacccagtgtagctcagcgtagccagtacagccacagctagagatttgaagaactgggccatccttccagctgggcactgtggcctggtttctgctcaattagagcttcaatcctcaagatgaaggaatcgagtctgctgggccatggagcaggcctgagtgcttgctctctgtgggcaagcatgtgtcctgtttgttaccacagctagaaacagatgcttctgctgagaagctgcctgcgaggaggctgttgatgcagagtcgtgaagcgtggcgaccgcggcaacccacatgacaaggctgacttacagactgtggcttcagtgctggggcaaacaacaaccaagaggtcctacagacactccagagccacaaggtcaccacatgtctggagcagatggatttcagtcaacacttctaccacccaagaagcttttgtggtgctgggtatagatgaactcaagtagcaaggttcgggctgtgcttgggaatcccggcaacagaagggtttgctggagtggtaccacaagcattgctgtagtgcaatttccatcttctatgtggagaaaagcccaagtacagactgtcaggacaaaaccaggcagcttccatccccaaaactgcccatgagtctccagccttggtaccctatggcctccgaaaccgcccaggggtgtgtgtatgtggtctctaatgaaaaacatcaagccaaaaatccagaaaggaatctgggcacaacctcccagtggccacaatccttccaggaagattttcttcagtaggctgaggtaaacagtcttacggaaagtgccatccagtatctccagtggtctggaagaccctgagaaacacttgctgaccaacatggtcatttgtctactcattactgcaggcgtttgttttttaagtgtgcatccgcctgcgcgtgcccgtgagcctgagcgtacgcgtgtgcgtgcgtgaggtgcggtgcggtgcggtgcggtgcgtgcatgcgttgcttgcgtgcgtgtgggcgggcgtgcaggcgtgcgtgcatgtgagagagagaacacatgccgcaggacacaaagaaaccagaggacttgcaaaagtcagttctctcaacaggtcagtcctagatacggatcttcggcagccttacccgctgagccaccacactggcccattctttcagtcatttctccatccatctggctctcctgaggtgagaaaccttggccctccaatccttgcagtcagcattggaagcagattgacagtgatgggcacataggagagggagcagtgccagatgacagggcaccgggagacattgcccatatcttacaaagggtgaagatccaaggactggtttgggagccttaggggatcagccagggcctctggtgtagcagagacccagcactcctggtcaactgtacctacagaggtttaatcatttctctttggtaggctgctatgaccaatggatgctttgaaaggtctgtactgacctgtggggctcacgcagaactgggcctagcaggtggggtttgaagtttggcagcctccgtgggaaggatgtgaggaggtagacaatgctctggagagactggagccctgaaaggggggcactggatgtttgctgctcagattgggggtgatggccactcctgggtcacaaagaaaggcagggacttctcatgggatcactcaggaaagagatctggagaacctggaaagagagattatcaggaaagtactccaaagccctctgggagcttttgctgagtctctaggttggtaccctaaagcttgccagggccacaaacctctcttggtgggattaagctgctgcaagggtcccagattttttttctttcacatttgagttgttacttatgggtggcacataaaattactcttgttttcccatcaacgtcgtagggtaggaacccaagatcggagaactgatttcttccatatagtcccaaattcacacccaagtgacttgcttcctctcttagctcctcccccaccatcaccacctcccagtaacactgtcatgctctggatccatcaccaagggcttgacccgatggttagttcagagcactcacgatctcacagtctctggaaagtcctgcatagacagaagtcccatcacttaatccactcgaggggacaagcaaatgaaccgtctcatcggaggatgaagaatcttactaccgggtcccgacatcagcttccatcctgctgccttgtcccaggaatgtcagacttaacacccacgtttccaacccaactgcatggctagtcccttaaaactcttcattccctccccagtctctctgcatctgtgtccatatctgtctaaagaaccatccttccgcaattggagctgtggccataaattttgcgtgtgtcatttatcggttgtttatgtcaaccatctcccttctctgttcctgttgtctgcctatcacctccatcctcatcaccctctgtccctatcatatatatatatatgtatatatatgtaaatatatatatacagttgatatgcaggaaatatatattcagtttatatgcaggatatatatatgcagttgatattgatatgcaagatatatatacagttgataggtaggatatatatgtgtatatgtatatattgtatatatatacagttaatatgcagaatatatatacagtttatatgcagaatatatatgcagattttaagtggactagcaagccccgagccctcaagaaccgctaggatccctgcccagtcatgttactgtcattggaagtcatcttctgtttccactccaccaccacagaaaagatccacttcatctgttgggcagggtggttgaggagaaccaagaccagggccctttaattctgtggaggaaccaaagacagctcctgctacataggagcctgtccggtggtatggggaccagggagaagttagaggtgtggaatacagggatagaatggtgtacaacgagggatcatggtgtaagggagggtactgtgaggacagtgtgtgaacagagtgtagacagtgagaagaacttggaggacagcatccgcagcatgggagagcaaaggaaggtgtgacgacattatgaagatattgtgggaactgcacgtgagtgtgaaagacagcatggggtagcaagggaggagctgtgggacactaagtgtataggagggaagtagcatgagacgctctagagcagttgttctcgaccttcccagagctgtatcctttaatacagttctcatgttgcggtgacccccagccataaaattatttcattgctactttgtaactgtaagtttgctaccgctatggagtatattggaaatacttgttggtatgcaggatatctgatattcagagtggctacccatggcataagaaccactgtgctaagtgggtagaagggccaccatggaaatagcatggggacactagaaagacagcatgatgagagtattgtgatagcattgggatggtgtggggtcttgtgaggatagggtggggacagaagagtagacagcataggtcgtcacagggacagtataggaacagtgtgaggacagtgtggacactgtggagatgttgtggctgaccttgaagagtgtgacagctgcactgtagtacacactgagcaggaagaggctgatgtagatgatgatggccgtccagaccccgtccagctccctgtcctgggagtcagcacaggtcttgtccagttccagccctggacaaagagggtagtcagtctctgtcccaacaaggctgggacaattccctctatggcaggtgcatcagcaatgaggtacccactggactgggccagtagattgtttctggggccagccttctgccctctccagaccagcagactacactctcccaactgctccaacccaagtcccggactcagccagacacaagatggcaatctggactgtgtaagaacccttcccacctgctccactcctcagatttggggctgtctgggctgaatcagagcctgtgaccactgaccctctgcctatgaccaagcccagaaagccagtgtaatggtggaccccaggcctagtgatgcctggccttcagagttccacactgggaagtgaattgggccactcagctatgtgggaaggggactgtcatctctatgggatgaaagcatgggtctgaaggtccagaagcagaatggcatgagagagtgtgtattgtgggacaagttgcctttggaatcctttggcagtgctatctgtctcagctgagccagatgtgaggaagagcctcagagaaggcctggtgccttgatgggtctgagttctgtactgggagctcctatgaggtctcggagtgtaaggcttgtgtctgtgctcatgcacaccagtgtacaagtctgtgtaaatgtcatgtgggttgaccgatggtcatcagactgctaggcactggagtcatctgatggctctgaattctgcattctgtgtcttcaagataagagacataggtatctagcccagaaaactagtctcaaggaggagagagggtcatggcaaaggtagacagacagaaattccagtgctttgacctgagatcctctccctgggcacaactgttcatcctggttgatctagagaagaaaatgacataagcctgacctccaatgggccatacctctgctgagcatcctctcatcagttttcctgtccatcttggtactgctgaccagatgggtcacacacaggtaatagcctggctcgtccagaagctgccaggcatgatcactgagctcctgaaggaagacagcttgaactataagacagatgtcgagtttcacataccagtgaacaaagctccagacttccaagacatgattgctggctcagggaagtagcccttgaccaaacaacccatgttgccatgggaaccaggaaagagatggacagggccatggctcttgctgcaaaggggggaagagatgtgaacatactgtccagcctggagaagtctttttctccatgcagccctgggtcttctaagatgggatctgctcctactcttcacgaacctagccagtttctgttttctctgaccccagcccctactcttagtctcaggaccttgcttttcacccccatccttacactgtaccccagccctgccagcatcgaatctggtcccaatgggttctttccttccaatctatagggttaactcccctgagcattcccactctcccctgttcctgtgaggccccaggatcagaattgtggaccacaaccccagaaataaaacccatggaatcccagcccccagagaccctccctgtgcacggcctccctcagtttagcaaagagttacttctggacccctgcctagcttctctctgcagccatatgacccactgcttataaacacagccagaagcgccagttccctttctcctctccacctggcttcactctgcactctgtactctcactccagacttcactttcctcctggagccacagacacttctgggctctagagagattgcatcagctggagagggaatggcagaggctgccaagtaggctggttagaggtcagacctgagagaaggtcttctccaaaaaggtggtcaggagaatggacataatcactcagccccaagcaatccaggaacactgggtgacagctagtctctacatcttcttctaagggtctcaagaggaccacttcacctacccctacaggaggtaacccagaccatgtctggactccccctggtctccccctaccccaaacactgaaaccaacagaagaaagaggaacctcaggaagtgtcccgtgtcacccagtttcgatcctgttcttagtctgtactgggttgggagaagtgtgatgttcacacctctggggcaaggactgtgaatcctggaaggatgagacagatctcagagctgggctgttagcagcccagcaccaatgcaaaaagagcagcagtcacaaggttccacacgtgaatgtagtcagcagagaagctggagaaagccacagcctagggagagcagtgagcttttccagacctaatagacggcagaacacaggaggatgaggagttgacagatcagccccaacagaggggcctgtctgttgcaaagaaaaggtgcctacctgcaacctggtgccaaccaggcagacaccagactttccacggacagaagccaagaccactaaagccgtgcccacctacagacaaccagagtaagcctcaaggagttaatgggatagacccggaaacctgagggtctagccaggcctagaggccggtggacccaggacagctgaaccaacagagaaaagaaaacccagtggagcaagggcagaggcatacagaattgagagagttggtaaagaggggatggggaacgttcacctgggaggactgatacacctattagaaagagctagagtcagagtggatgcccttgtgactcccggcattggatagcagatcccaagaacaaagctgaaagaaggtaaatttctcaagagaaagtcttccagaggaactatgggtaccaggcaataagtagtacatccgtaggagggaaccagacagtagtacatctgtaggaggggaccaggcagtacagctgcaggtagggaccaggcagtatatctgtaggagaggaccaggcagtatatctgtaggaggggaccaggcagtagtatacctgtaggaggggaccaggcagtatatctgtaggagaggaccaggcagtagtatatctgtaggagaggaccaggcagtatatctgtaggagaggaccaggcagtagtatatctgtaggaggggacaaggcagtacagctgcaggtaagctaaggacagtaagagtagtagagagccatgatgactccaaaagctcagaagacctggcagagcagctacagggaatccggggctggtggagttgggaggaccaagccaaagagctataggtaagccgaggctggtgaaggcacaaaaacaagctaaggagctacagagggggcaagggctgtggcaggtgtggctaagagaggtccagggcacccccaggaaccagaaagagctttacaggagttctagaggaggaaggagttggggagacaggctgggcatctgtaaagataaggtagcagttgtcacagtttgggtctcagagctgcccaggggattaggggaaaattctgagaagctgtgggagagtaggggatggtaggaatgtggaggaccagtcctagcagctgtggggaagctggggatggtaggaatgtgggggatcagtcctagcagttttggggggagctggggatggtaggaatgtgggggaccagacctagcaattttggggggagctggggatggtaggaatgttggggaccagtcctagcagctatgggaaagctggggatggtaggaatgtgggggaccagtcctagcagctatggggggagctgggatggtaggaatgtgggggaccagacctagcagtttttgagagctgggaatggtagcaatgtggggtccagtcctagcagctatggagtagctgtagatggtaggaatgtgggggaccagtcctagcagctgtggggaagctggggatggtaggaatgtgggggacaagacctagcagctatgggtgagctgtagatggtagaaatgtgggggaccagtcctagcagctgtggggaagctggggaatggtagaaatgtgtgggattgttcctagcagctatgggggagctggggatggtaggaatgtggaggaccagtcccagcagctatgtggggggctgtggatggtaggagtatgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggagtgtggaggaccagtcctctcagctgtggggaagctggggatggtaggaatgtggggggcctgttctagcagctatgggagagctgggaatggtaggaatgtgggggaccagtcctagcagctatgggagagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcccagctgtggggaagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcacagctgtggggaagctggggatggtaggaatgtggaggaccagtcctagcagctatgggtgagctggggatggtaggaatgtgggggaccagtcctagcagctatgggagagctagggatggtaggaatgtgggggaccagtcctaggagctatgggagagctggggatggtaggaatgtgggggaccagtcctagcagctatgggagagctggtaatggtaggaatgtgggggaccagtcctagcagctatgggagagctggggatgataggaatgtgggggacctgtcctagcagctatgggagagctggggatggtaggaatgtgggggaccagtcctagcagctatgggagagctggggatggtgggaatgtgggggaccagtcctagcagctgtgggggagctggggatgataggaatatgggggacctgtcctagcagctatgggagagctggggatggtaggaatgtggaagaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtgggaatgtgggggaccagtcctagcagctgtgggggagctggggatgataggaatatgggggacctgtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggaacgtggaggaccagtcctaggagctatgggagagctggggatggtaggaatgtgggggaccagtcctagcagctatgggagagctggtaatggtaggaatgtgggggaccagtcctagcagctatgggagagctggggatggtgggaatgtgggggaccagtcctagcagctgtgggggagctggggatgataggaatgtgggggacctgtcctagcagctaagggagagctggggatggtgggaatgtgggggaccagtcctcgcagctgtggggagctggggcaggtgggaatgtgagaaaacaatccttgagctatggaggagctggggatggcaaggatgaaaaggggcaaatcctagcagctagagggaagctggggcaggtgagggcgggtgtaaggaaccagacctagaaactatgggggaagtggagcaggtaaaaatgtgataaaccagttatgcagtccagaggctggtaggagtgtaagggagcagacatagtggctatggggaactgggatatatgggagtgtaagggaccagattcagtagctatggtggaacttgggagtgtagatgagcacgctgaaaagctatggtgcaactgcaacaggttgtcagggtgtaaagaaccagacccagcagccatgggaaacctggggaaagtagcgatgtgggggaccagatttggcacctataagggagctggggcatgtggacatatgaggggccagaagcagcagttatagggaaactttgaaatataggcaagtgtaccaagaagccgtagtggagctgaaacagatcctaggtcctatggaggagctgaagaaggtgggagtgtgagggaccaggccgagcatctgtggaagggctgaggcagggctctgggtcggatgggagtggcaccccagagaagccctagaagctctggcgatggagctgagcagttacagtggacttggggctggtgggatcgtaggagaccatgtagctgcagaagagctggagaaaacaggagtatgaaagacccagccaagtagccactgaagagctggggtgttattggggtgtgtggggacacagtcccagcaggtttatagaggttggagccttggcagtatgtgcagtaccaaacccagcagcttggttcaggggcttgagtagaggcaggctaatggggtccacggtaaccctaggcacttaggggactggattgcgaatcttcaggggagctggaacaggcaaagttaaaaggaatcaagcacctggaagaaagcaaggaaagataggattgatggggatccaagaaactcccaggaagtaaccccagcagggacatctgggagctcagttcagacactgaatcaaaagcacagaggaaggagaggtggtaggtttccaagctatcctgtccaggccaatggagcagccaggaaggagggaaggagaccaacaggaatggggcagctgtagccagcagggtgtgagagacagggatgaggctaggtggctagcaagaagggcaacttagtgggagaggggtgaattaaccaccctgacctcatgctgacaggggctgagcaacagacaaaagaataagaaagccaagagctcatggctggaactattctggctgtctgctctgactgtgttgaaggggctaagcacctgttagctaatgaggctaaaacagttaaatgagcaaagtagagcaaaaagctcccacagcggagagcatgggagaacgggagactgtgagatcctcggggggtctaggagtttatctcagagtgaagaacagtgaaaagctctgcttgggagttctttggggaatggcgatcatcctgggaactcccttatagacctcatggcatggaggagagcaggagctcaggcagacagagtagctgtgtgtgagctggataagaaagaaaagagacaacagggagagaagagaaaagggatgggaaaggactcagggctctactgaattcaggcagaagagcttggcttcaggatgctgggggccaaggaaggtgtctgattgagcaggaacatagtcaggaaaagaccctggtgctcacattcccagacaaatcttacaggttaaagttctagtatcagaacccctcgctcagatcctaggggcttatgggaacataaggcaggaagtgaaacctcttaggacagcacgaagtagcctgtgttggcccacagaagaagagcaaggtaactctcagagtttgagcaggggattgaggaaggtagtgtacaggagaggcagaaagaccagaaaggtccccagagtaagaatgaatcaagaatttatgtgtggtttggttcgatgaaggcaaaggcagggaagatagatgagaaactgatcctctttcacaaccaagaactcattgttcagtgtgagttttgatatatagaaggggggggaatgtgctattaaaagtaaaaaagaatgaaccagattcaaaagggaaaggggactaaatgtcttcctgaataatgcagcatacattcctatttcaagagctaccggcaagagaaagggacacttctgggatgtgcccagtaacattagcactgtcagagagaacccagggcagtgcgaagggtgaggtgggggaggaaggtgtctgcactcatcagcgtctcatcagggggcactgagctgtgtagaacaagagtggccagctaggtcaagacagaaaggatgcccacacacagaaggtgtagggtagagggttggtagtaatccccaggaagcagggagcaaggtccaaggagagctaaagtcacggatagagacctagggcacagatttaggagccagagtttgtgtaatgttagtagattcagtaggggcttctgaagggcctcatcactgaaagatcaaggctcctagggctggagagttggctcagtggttgctgctcttccagaggacccaagtccagttcccaacaaccacatggcatcttacaactatctgtaagaaactccagtttctcgagattcaataccctcttctaacagcacaggcatcaggcacacacatagtacacatagtcatacatctaaaataaaatacctaaaaaaaaattaaggtcagagtgcagggtctagaagtggaagctgctgacaccacttaccccagagcaacttgagaagacacagtctttttagagcaaagctaaggccagagcctctccaaatatctgaggccacgcatgttggaaaagctcacactccctcctctcttgcagcccaaacaacagccccatctgtctatccactggctcctggatgtggtgatacaaccagctccacggtgactctgggatgcctggtcaagggctatttccctgagccagtcaccgtgacctggaactctggagccctgtccagcgatgtgcacacctttccagctgtcctgcagtctgggctctacactctcaccagctcagtgacctccagcacctggcccagccagaccgtcacctgcaacgtagcccacccggccagcagcaccaaggtggacaagaaagttggtgagaggacaaccaggggacgaggggctcactagacgtgaggataaggcattagattgcctacaccaaccagggtgggcagacatcaccagggagggggcctcagcccgggagacactgtctctgcctccctcctggaggcctcctggaggcctctgcctatggccacccaccccctaagacatgatcctctggtatagatgtctgtgtcatgcataggatcataccagggacaaactttcctctctggtttggtgccttctctccttgaaaacccagtaacatccagtcttctctctacagagcgcagaaatggcggcattggacacaaatgccctacatgccctacatgtcacaaatgcccaggtaagtcactagacctggaccccagctccacaatgatggcaagagctgtaagcatcccagcactgcaggataagccacgtactgacccatttctatctctcctcatcagttcctgaactcttgggtggaccatctgtcttcatcttcccgccaaagcccaaggacatcctcttgatctcccagaacgccaaggtcacgtgtgtggtggtggatgtgagcgaggaggagccggacgtccagttcagctggtttgtgaacaacgtagaagtacacacagctcagacacaaccccgtgaggagcagtacaacagcaccttcagagtggtcagtgccctccccatccagcaccaggactggatgagcggcaaggagttcaaatgcaaggtcaacaacaaagccctcccaagccccatcgagaaaaccatctcaaaacccaaaggtgagagctgcaggccgactgcctggggactgggataggtataagaatgaatgcccgtgtggacggccatgacctctgtgtctgtttctatccccacagggctagtcagaaaaccacaggtatacgtcatgggtccaccgacagagcagttgactgagcaaacggtcagtttgacctgcttgacctcaggcttcctccctaacgacatcggtgtggagtggaccagcaacgggcatatagaaaagaactacaagaacaccgagccagtgatggactctgacggttctttcttcatgtacagcaagctcaatgtggaaaggagcaggtgggatagcagagcgcccttcgtctgctccgtggtccacgagggtctgcacaatcaccacgtggagaagagcatctcccggcctccgggtaaatgagcacggcacccagaaagctctcaggtcctaagggacactgacacccatctccacccttcccttgtgtaaataaagcacccagcactgccctgggaccctgcaaaactgtcctggttctttccggggtatagagcctaggtcacgggctttaaggtctggctggggtttaaggccagagttgtcttcaggaagagagtgaggtttccacactgccagactcagagctcatgagtcatcagggcctggagtgttggggcttagctttaggaagtgcctattccttgacttcaaactaaccagcagctgccagacggagagatacacctaggaaacctccaagggaagaaacacacaaactccaccaccctctgcctgttcctatccccatgtcccactcctctgcctatgggtttctctgagtctattgcacacatggccatgggcgtgccagagacccttgctatccctacactcaactaaacccaggcagcttttcatgggctaggtctgcacacccatacagactgcccactcatgcctgtgccacgtgagactgaggcagatggctcttgccgcccaaagggagggtctgttagccacatgcatactgaatcctgacccattcaaatcagcctgccgaacatcatccagtccgtatagcacatgtatccacgtgcacatgtgcacacacatttaacacaccaggactccgcctgtgtgccctgcacagcacctacacccagcagtgtatcaggatacccacaaccaccacttgagtgcccacgtttctgccatcacaaccagacacacctttccccttctaaggtcactgcattctaggctcagcacaagtcctctgaagccagatccgtctctggtacctcagggtcacgcttcaaccccacatgaattatacaacccagagccataatggtctgagtcacttcacactctggaattttctcaagttcaggcaagaccaggcacaggctccgctggtgattgagggacaggtaaagggtcagaccagctgtatagccactgtccactggggtcacaggccctgctgacccttcaccttctcctgtactgcaaacagagagggcccttgcacaatccaggccgccatgaggtccactgtgtctggcaaaccccaaggccttatccaactcagccggagggaacttagactgatgtcccagagggaaaagaaaggaaagtagggagtagaaagtctcccagggagactctgctggcccagcccaaatggagctttctcctctgccacatggggaattgctcccagccccccactttattgggacaaattctgactgccctctctgtccagggctagaagtggatgatgattgtgctgaggctcaggacggggagctggacgggctctggacgaccatcaccatcttcatcagcctcttcctgctcagtgtgtgctacagtgcctccatcacactcttcaaggtcagccacaccatcccccaccatctgctgtgatgcctgtgtcaaccctgcgatgtcctcacactcctctcctgacgtagtaggatgttcccttgctgtccccactctgccccacacaccattcccaccgttccctgagccgtcccacattgctctgtgtggctacccatggcgtccatactgtctgacattctatctctcttgctgtcctatgtgatctccatactgtcttacgaaacctccttgcatgccacactacccttcatgacgtccctgctatctaccatgctacccctctgggtgtccccatcagcctcaccatgtattctttgagctatcctcataccatctcaacctcaactcccacgatgtctccacaccggctcctagtctatgtcaccctgaccccttgccatccccagtctcctgcctgtatgaaaggaactgcaggagggacgggcctctgtcttgcccacagggctgaagggcctaagcatgggtgtgttctctgacttactcccacctccccacaggtaaagtggatcttctcctcagtggtggagctgaagcagacaatctcccctgactacagaaacatgattggtcaaggagcctaggccacttcctctgggatgagcttcctgggccccgcacaaccccatccatcctactgtgcagcctaatgtggaggccacactgccgtctgacagtgccaccctctagccctgtgactctgatccagaactctagactgtcttccttttggaggatcatgtggacaatgagctataccccagacccaaacagcacctccacagcagttgccaggaaactaactggttgggaccagaagaaccatctctaggatgtttgcctcagaggagctgggagtccacggtgcctgagtcgagctccatgggaatcagccgtgtctgaaatgggtcttcccagaaagagcaatgttttcagatccttgaaaggaaacatctgctaggaagaccatggtcgccacagccccaaagagtcacttcactctggtagcctttgaaccagttatatctggacaccttctttcccggtacttctgtgaaccctgggctgagtaaggggtttatgtttctcaaactgttgggatgagcctccccgagatgaagctccttgtgcagtcttctcttcccgaaacccactcaacatgctggactcttgggttcaggatccgatccgaagacaccattgacgacgcaacctcaagacaaggccactgtcacctccatagagactccatccacactctgcagggacaggaggactgctttgtgtaacctccgcaaagccctagcagggacaagtgcacagaccactgagtattggtgaggtgaccaggcaggaaaacctccaggagagggccctgatgagaagattcatattgggctcaaaaaatgggatggggggaggggggcgggtgggaaagaacagtgggcagggtgtgaacagatgattagaagacagtcacagtgccgcagatctgccctgcaggcctgctttccagactggaccacttacagcagaaaacaacagttacagtaagcatctaggagagtggacctggaataccagggctgctgtggccagtggagagtagccctgcatctacttctccattacctctcatggccaataagaagccagagcatccaggcagaaagaaagagtgtgcgtttctgtgactggtaggaaatgcttagagaacttggatctttaaaacagcttttttctagactgtgaatgtctttaagcactctctttcctctccattccctccctctctctttctctctctctctctctctctctctctctctctctctctctctctctctctgtgtgtgtgtgtgtgtgtgtgtgtgtgtgtgtgtgtgtgtgtgcactcacacacactgttgttttggcattttaaacaataaaacattcttttaacattttgtatctcatggtgtcccttcttaatggattagccctaacaccaaggaacagggcacagttaacagatcaattagccatgcacatccctcctgaccctgtcctcccagggttccctcagtgggtccctcatggctgggttccagccctaccagagccacaaaaagcttgggcatattcctccacacacacagcttttttccccagctggagactgctctgctgccatgggcaggctgtggagcagggctgatgcccagggtagaccctaggctagccagacaaaggtcccatgacagcagagaagcatgtgcctctcactggccttgggctgctacagagtcagcaaaggacatggatccagctacctccacagctggtgctcattgtctcaagccatgtccagagaagttccagatcaggcattgacagggtggagagctctctccttggttggtaggtgtcttctcctccatgtgacctcagagccccccccctttctgtgtgtgtgtgtgtatgtgtgtgtgtgcgcgcgcgcgcgcgcgcgtcctagcctcttctcataagtgcacagtcaggccggaagaggtgcatcctagccctaatcataacttaccagtttatgatcctgtctgcaaacataggcatagtctgaggtcctggtgatttaaatgtcaattggtgagtcttctggggcttcctacatacaatgccccttccccatgccaacatcccaaagtctcacccatccagcattcagctctatcccaagtcacctccaaaggcctgctagtcaagtaaggatcagatcgtgtggggttcgtcctgagataggattcagccatggtttccaggaggaaggggcaggagagaggcacaggggagagacgtataccgtgatgaactggacagactgataatgtgctgtccagaagaaagctgagggcaaacaggggcccctcccacttacactgaggtgacagttcctaagggagagtgagggatttgtagagagaagtggaggttccacagagttggagaagcaaaagattactagaggtagcctggtgtttgcaatgtctgttttctgttatggttgacatcaggattccatgctactctgtagatcaagggatacaggttccacatctttgtgtggcactgtggtggaggggcttgggcccagatactcccgggacatggaaaatacagacatcggcaggggaagaaatgggatgattcacaaccaaaggcctcctcatccgatgcttactgatctccgagagcaggagtcgggtgctggctgggcagttatcatctcccagtatttcccaggtggcatttagtagctgagacatcttcagattgtggccttggctgttagacactctatctgtttgggtctgtgtaggtgatggtggaggctgaatgaaggactggacaagggacaaaaggatcaggtcaacaaagctgcagcagagacaggagccaacctgaccaacaccactgtggcttccatgggacagttctgttttagccaggacagaagggaacagagctgcgtgaatggcattactcctatgggagtcacacagacaggctaatcacccagacaacaccaactggccagtgagaccagtgagatcctgcccacgcttcctcttaggtctggctctgtttctctagttgtcttccctggagcaaatgttgggaattgagcccatatcctctgcaagaccagtaaatgttaactactgaggcatttctccagccctgcctcaacctcttactggaagatggtcccaaaccaaaactgacggcatggtctcagaaagtacagattcgccacctccaaacccttctctcatgtctgtctgtctgtctgtctgtctgtatgtatgtatgtatgtatggccctgcaccatcacccaccacctcctggtgtcctgcagcaggggcttcccacagcaggacgtaccatagctcccaccccttacacctccatcagcactataaacatatagacacaagtgccataaccctggacacaccttctgaccccgcccccatctctgagaccaactgatctcaggctgtgttttactgaatgtgtccattcggtaaaagctatctgagtcctgccctcctgacctctatagtgtgacatccatggtgtgtgtcctgtgtcataacacgtaggtatgtcataccgtgtgttaccacatatgatatgtgtgtgaaacatccccacatgatgcctgtggtggacatgtatatatatatcttttatgacttctataggggacatcaattgcagaatacctgtgctagccagtagccatgactgaccagacagctactgacacttgacccacttgcattctgtcacagtctgggaatcataacatgacacaaacgccgattgtagcaccaggtcatgggcctgcatgagacttgacatgtgtacacacatgacatgtgtacacacaaaccacacgaaaaagtgtctcggaaaacacacacagacacatccacatgagcatcatagtgtggtcacagacatgtccacatgggcatcacagtgtggtatcatgtagtagccacagcatacatgacacagtcacacaagttcttacaagaacatacatgtctgccagttcccagaactcctggcctcaggctcagcactggccaccctggcccagcacacttcccatgcttcaagctttgcacacacagatccactgtattcccttcctgtgtttaccccattaccttcagcacaccacccacctctcttccatgactgcccccatcccacctagcacggcgccccactactgtgctagctttgttcactcagtgaccatgtgtgtccatcttccagtgaagcttgagctctggggacaagaacgtccctccagattcatgttcctgcagttctatccaactgttcagcatctgtgatgaagtcacaccaagtccctcaccccctaactagtcttctaatctggcatagttatgtgctgggaactaagtagatggtcaaagtaggatatgatgctggccaatggtgcagaccagtaggtccatgtgctgacccttcaactctaaagtcttccccacgcctaccatgtagccataagatctttcccccaaggcagggtacagacaccacatagaggaagaagaccaagtggatgggccccccatagcaggtatgggagagtcaggctgacatagcaagtgtgggagagtcaggctgccatagcaagtgtgggagagtcaggctgccatagcaagtgtgggagagtcaggctgacatagcaagtgtgggagagtcaggctgacatagcaagtgtgggagagtcaggctgccatagcaagtgtgggagagtcaggctgacatagcaagtgtgggagagtcaggctgacatagcaagtgtgggagagtcaggctgacatagcaagtgtgggagagtcaggctgccgggcacaaaggatatgctggacttagggaagccatcctccctgttttctgcccaagcacatatgtatcctactatcagctctctcattgttcactccatactcaagcatctgcccataggaggaagacctcagcctcaagtcaggatgtacatgagagcagccacagagtgagtccatatagttctgttcttttgccccaaaatgtcatgttccagaactacttgttcctttgacctagaccccagaaaagagaccagacactatagtagacacggaagtaagaacaacacagtgctgttgtttctctgctggcaaaggttgttgccacacttatccctggcaaagatataaaacagatgtcatcaaaatgccagtcctggttgtaaatacatatttagaaatgtctgtgtgtgtgtgtgtgtgtgtgtgtgtgtgtgtgtgtgtgtgtgtgtgtgtgtggagacaacaggtaaaaaaataaagacgatgttagagggaggaaattaaagttggaaatgatataatcatatttttattggataatttatatttacatttcaaatgttattccttttccaggtttctcgtccataagccccctgtcccatctccctcccccttcttctataagggtgttccccctctccaaccacaccccattcccgcctccctgccctgacatttccctgcattggggtgggggggatggggttccagccttggcaggaccaaggacttctcctcccattggtacccaacaaggccatcctctgctacacatgcagctggagccatgggtctgttcatatgtacactttgggtagtggtttagtccctgggagctctggttggttagtattgtttgttcttatggggttgcaaaacccttcagctccttcaatcctttctctaactcttccaacagggaccccatgctcagttcaatggtttgctgctaacatccgcctctgtatttgacacactctggctaagcctctcaggagacggctatatcaggctcctgtcaacatgcacttattagcttaatcaataatgtctagttatggtgggtgtatatatatggactggatccccaggtggggcaggctctgaatgtccattccttcagtctctactcagaaatttgtctcaatatctcctcctgtgcatatttttgttcccccttttaagaaggactgaagcatctgcaccttggtcgtcattcttcttgagcttcatgtggtctgtggattgtatcttgggtacttcaagcttctgggctaatttccacttatcaatgagtgcataccatgtgtgtgtttctgtgattgggttaccacactcaggatgatattttctacttccatccatttgcctacagatttcatgaagttattgtttttgatagctaagcattcattgtatagatgtaccacattttctgtatccattcctctgttgaagggcatctgggttctttccagcttctggctattataaataaggctgcaatgaacatagtggagcacgtgtccttgttatatgtcggggcatcttttgggtatatgcccaagagaagtatatctgggtcctcaggtagttcaatgtccaattttctgaggaacctccagactgatttccagagtgtttgtaccagcttgcaatcccaccaacaatggaggagtgttcctctttctccacatcctcgccagcatctgctgtcacctgagttttttttttttttttttagagagacatggaagaagattgtttgttggtctatatttatggcttgctcagcctgtggttttgttttttattaacttgagtatttcttatatacatttcgagtgttattccctttcccagtttccgggcaaacattcccctcccccctctccttccttatgggtgttcccctccccatcctccccccattgccgccctccccccaacagtctagttcactgggggttcaatcttagcaggacccagggcttccccttccactggtgctcttactaggatattcattgctacctatgaggtcagagtccagggtcagtccatgtatagtctttaggtagtggcttagtccctggaagctctggttgcttgacattgttgtacttttggggtctcgagccccttcaagctcttccagttctttctctgattccttcaacgggggtcctattctcagttcagtggtttgctgctggcattcgcctctgtatttgctctattctggctgtgtctctcaggagcgatctacatccagctcctgtcggcctgcacttctttgcttcatccatcttgtctaattggatggctgtatatgtatgggccatatgtggggcaggctctgaatgggtgttccttctgtgtctgttttaatctttgcctctctcttccctgccaagggtattcttgttccccttttaaagaaggagtgaagcattcacattttgatcatccgtcttgagtttcatttgttctaggcatctagggtaattcaagcatttgggctaatagccacttatcaatgagtgcataccatgtgtgcttttctgtgattgggttacctcactcagtcacctgagtttttgatcttagctattctgactggtgtgaggtggaatctctgggttgttttgatttgcatttccctgatgactaaggatgttgagcatttctttgggtacttctgagccattcgatattcctcagctgagaattctttgattacctttgtaccccattttaataggattatttgactctctggagtctaatttcttcagttctttgtatatattggaaattagccctctatcagatgtatgattgataaaaaatcttttccgatctgttggttgccattttgtcctaatgacagtgtcctttgtcttacagaagctttgcagttttatgaggtcccatttgtcgattcttgatcttacaacataagccattggtgttttgttcaggaaattttccccagttcccatgtgttcgagggttcttcccactttttcttctattagtttgaatatatatgattgcatgtggaggtccttgatccacttggacttaagctttgtacatggtgataaaaatggatcaatttgcattcttctacatgctgacctccagttaaaccagcgccatttgttgaaaatgctaatttttgtccattgaatgattttagatcctttgtcaaagatcaagtgaccatacttgtgtgggttcatttctgggtactcaattctattccattgatcttcctgcctatctctgtacgaatatcacacagtttttatcactattgctctgtagtactgcttgaggtcatggatggtgattcccccagaagttcttttatggttgaggatagttttcgccatcctggattttttgttattccaaatgaatttgcaaattgctctttctaactctatgaaaaattgagttggaattttgatggggattccattgaatctgtagattgctttaggcaaaatggccatttttactatattaatccagcctatccatgagcatgggtgatctttccatcttctgagatcttcctcaatttctttcttcagaaactcgaagttcttatcatacagatctttcacttgcttggttaaagtcacaccaaggtattttatggtatatgtgactattgtgtcataatttctttctcagtcttttatccttggagtagaggaaggttactgattggtttgagttaattttatacccagccactttgctgaagttgtttgtcaggttaagtagtctcttgtggaacttttcgggtcacttaactatatactatcttatcacctgcaaatagaggtattttgacttcttcctttccaatttgtatctatttgacctccttttgttgtctgatttctctgggtaggactttgaatgctatattgaataagtaggaaaagagtaggcagccttgtctagttcaattttagtgggattattcaagtttctctcgatttagtttaatgttggctactggcttgctgtatattacttttacattttatattactttttttatgtttaggtataggctttgaattattgatctgtccatgacttttatcatgaaggggtgttgaattttgacaaatgctttctctgcatctaatgaaatgatcatgtggtttctatctttgagtttgtttatatagtggatcacgttgatggttttctgtatattaaaccatccctgcaaccctgggatgaagcctacttgatcatgatggatgattgttttgatgtattcttagatttggtttgtgagaattttattgagtatttttacgtccatattcgtaagggaagttggtctgaagttctctttctttgtcgagtcttgatgtggattaggtataagcataattgtggcttaatacaaggaattgggtagtgctccttctgtttctattttctggaatagtttgggcatagtttagtatgaggtcttctataaaggtctgatagaattctgaactaaacccatcctctcctgggcttttttttttttttagttggagacttttaataactgctcctatttctttagaagttatggtactgtttagatggtttatctgaccctgatttaactttggtacctggtatccatctagaaaattgtacatttcctccagattttccagttttgttgaacttaagtttttgtaatagaatctgatgatttttttaatttcctcggattctgttatttctcccttttcagttctgactttgttaatttggatacgttatctgtgccctctgattagtctggctgaggatttatctatcttgttgcttttctcaaagaagcagctcctggttctttgtatagtcctttttgttactacctggttgatttcagccctgagtttgaagggctcttcaaactcctctactcctcttgggtgtatttgcttctttttgttctagagcttttaggtgtgctgtcaacctactaatgtatgctctcccctgtttctttttggaggcactcagagctatgagttttcctcttagcactgctttcatttgtgttccataagtttgggtatgttgggccttcattttcactaaattctaaaaagtctttaatttctttctttatttcttccttgaccaagttatcattgagtagagcgttgttcaacttccatgtatatgtgggctttctgttgtttttgttgttattgaagaccagccttagtccatggtgatctgataggatgcatgggattactgcaatcttcttgtatctgttgaggcctgttttgtgacagattatatggtcaattttggagaagctaccatgaggtgctgagaagaaggtatattcttttgttttaggataaaatgttctataaatatctgttaaatccatttggttcataacttgttagtttctctatgtctctgtttggtttctgtttccattatctgtccattgatgagagtgggatgttgaaatctcctactattattgtgtgaggcgcaatgtgtgctttgggttttagtaaggcttcttttatgaatgtaagtacctttgcatttggagcatagatattcaggattgagagttcatcttggtggatttttcctttgatggatgtgaagtgtcctttcttatcttttttgatcacttttggttgaaagtcgattttattcaatattagaatggttactccagcttgcttcttcagaccatttgaggtagtgtctgtctttgtctctgaggtgtgttttctgtatgcagcaaaatgctgggtcctctttacatgtccagtctgttactctatgtctttttattgggaaattgagttcattgatgttaagagatattaaggaatagtgattgttctttcctgtttatatttgttagaggtagaattgtatttgtggggctttcttcttttgggtttgttgcaagaagattactttcttgctttttctagggcataatttcctttattgtgttggagttttccatgtattatcctttttaggactgtgtttgtggaaagatattgtgtaaatttggttttctcacggaatatcttggtttctctatctatgttaattgagagttttgctggatatagtagcctggcctggcatttgtgttctcttagggtctgtatgatatctgcccaggatcttctggcttttcatagtctctggtaagaagtctgctataattatgataggtcttcctttgtatgttacttgaccttttttccttactgcttttaatattctttctttgttttgtgcatttggtgttttgacttttatgtgatggaaggaatttcttttctagttcaatctatttggagttctgtaggcttcttatatgtttatgggcatctctttctttaggttagggaaattttcttctataatttttgttgaagatatttactggccctttaagttgagagtcctcactctcttctatacctattatccttaggcttgatcttctcattgtgtcctagatttcctggatgttttaggttaggaactttctgcattttacattatctttgatggttgttttctatggtatcttctgccctgagattctctcttctatttattgtattctgttggggattctttgcatctatgactcctgatctcttccctaggttttctatctccagggttgtctccctttgtgatttctttattgtttctgtttccgtttttagatcctggatggttttgttcaattccttcacctgtttgattgtgttttcctgtaattctttaaggggtttttgtattttctctttacaggcttctacttgtgtttcctctttaagggcttctacttgtttatctatgttgtcctgtatttctttaaggaagttacttatgtccttcttaaagtcctctatcaccatcatgagatgtgatttttaaatccaaatcttgcttttcctgtgtgtttggatccagtatttgctttggtgtgagaactgggctctaatgatgccaagtgtccttagtttctctttcttaggtgctgcgcttgcctcttgccatcaggttgtctctggtgttagattgtcttgctgtctctgacactggcttgaccctcctgtaagcctgtgtgtcagcactcctgtagacctgttttctttcagctggatctgggaacagagagctgctcctgggtttgtgtgtcctgaggccaccaggcaggtcgcttggagcagaagtgttggtcttacctctgctctcaggtgtgtcagcacttctggcaactggctttcagctctggacacaggcagaaaccagaagatttctgcccctgactgctcctagcttcctatgtccagagggcacagagggcactaggtgggttcctcttggtccatgaatgtcagcagaagtagttgtctcctctgagctctcaggactgtccacacttttgagagtccatctctctcccccacaggatttgggaacagagagctgtgggagcggttcagctccgggtgcaggtagaaaccaaaagtatcctgtactagacttctactgcctttattgatataaccatattttaatcccaaaagcaaaaataaatgctttatttctggtcttgagctaagggtatagttcaattgttagagtacttgtctgtaatgcaggagccctggatctgatctccattacagaataaaccaaatgtggtaatgcatgcctgcaatcccaaatcccaaatctccaaaggcgtacacaggaggatgagactttcgaagtcattcttgtctacatagcaaattagagaccaaccttatctttaaaaatagtaataatcctgatcttccacttgaagtaaatgtatccagtaactgtacctgataccattctatgttagattttgtttcagggtttcgaagataagttctccagagaagcacaagtagtgggagatggcggagagagggctggtagatgaacccataaacaacaaacaacagagctggaggacaattaggatgatatgtagttagaaacagagggacagcatataagagacaacagggagataacacataagagacaacacagggataacacacaaaagacagaagagagataatacataagagacaacagagggacagcgcataagagacaacagggagataacacgtaagagacaacagagggataacacataaagacttagagttttatggttcgccttgactagattaaggaatgaatgcctgtggaggtgtctatgaaggactttccagaagtgttaggtcttagggggctctgacttagccctttggtggagtgagaatgtggtggcattatagaaaaatgctgaacagtaagaagtccaggtggaggaagcagattactgggggtgtgcatgggccattacatctgaccctggacactacattccctttatctctacttcccatcagtcaagaaataaatagcctcttccacacaaccccactgtcattatggccctaagcacataagccccccaccctttaagtttctttgaggtatctggtcatcctggctcccagctccaagtcacccaaagggttcatataggcaagcatttccacctctaccgtgttccatcacaaaccactggctatttgagaaatttcagacagctaaagaatggttctcttagcactgatggccttgcattcaagagacttgcctgctggtttgcaaacctagaggctatggcactgaacttggacacccggtggcgtgctgcttttggcatagagaaagctgacatccagcagctaagtgactgctcctgagctttggaactcgttctcctgtatcaccctctacatccaactcttctcagcttgtcttctcaatatttccactgtccctcatcaccttagattcttgtagacgctgccctcaatggcttactggctcctcaactacttcctgccactgtcgccctcagggctggaaacctggagccttgtctgctcttggcacagccacacagcttactctacccatgacaaataaggagacttggagaccatttggggaaagcctttatcagggcctaatgggtgcacacttggatcaggagtcatccattggagagaagcctcaaggaatagtggggaacatactgtatctagagacagtatagggtcatgatggcgtggattatactccccacaaagacagccctgcatgtgctctgcttccagtctcaccaatcacaaccctcccgtatgaacccatcacagcccttgcacagattgcaggtctcaaatatgttcacctttctttctgacataaccaggattttttttaatttgcttgcgtgtttattatttctatttattttattcattttttatttattattttacatcccactcactacccctctccccatcatcccctcccaagatccttcccccatcccctctccctttcacctctgagccagtggtgccccctccgtgtatctcccaaccctaataatcaggtggtttgagccaccagggaagatgctcttcttcctttctgaccttgagagctgctattccaaggtcctctggagctgtgtgtgtgaagtcacctggaggtcataggtggagtggagttttaaggccatggtagaggctggagccatagtagttggaacaaggctgtggtttcagcagcagccatgattgttgtatactttgcagctcaaatatggtctcctcagggctctgtgaggtattcaaagcacctagaatcccatgatgacacttccaccagtctctaaaagagacctaagactactagatatagaaaaaggccaacttaagtacatcaaaaggtcaagccttctggcccctaatggctcattttacatgaagaaaaggtgaccattacactatgcccaataaagacatgttacatttacactacggtccttggcatcccttagcagatgatcctagggagagctgagcaatctcgtccatctcacctccacccagtcaccaaaataacactgttctaaggcacacttctgagacttacagagctactagagagttgggggtagcagtaagacctttccctggccctcaagatacgttcacacccacatcacatatatgagttcgcatacactaacacacacagcacatcttggacatggcccattcaggaacagatctgtcatgatcgcttgagttaaggaaccactcaagggaatgactaaaggaggatcccactggagtcctggcccacaggaggaggtggaataaaggttaggtagggcaagacaagggcactaaagccactatgctgctggggccactgtggacactgatggccagaaatggaatgatcagcctgtaggcaggaggggggagggaggatgattcctgaaaaccagaagagtcaccgtggagtctgaaccaggaaggagagagagctcccagtgtaaccctaaggcttaagtagttgcaactgcctcctctccttccagaggaccacccactgccacctagcatagcactctgaggactcagaaccagcagcccagcataagctgagtgtcaaagaagaatcaggcccaagcaggctggacacaaagtttcttggtcctcaggctatgagggagatggagtccttcccactattcggggcacaccacagacagcagcacctgatccagttggagcaaaggctcctcacccctgtgttttccctcagaaccacaagtctttccaggaaactctgtatttacccctcagattcccacccaggtctgttaggctaaaggccaagcctgtcacctcagactatctgaaagagataaaaccaggcaagacccccaattccctcagatctcacaccccgtgttcccaaagtccctaactaactttcctggggccagcccggggcctacctggttcttccactgtcagttagctctctgatgtcttccaaatacaattaaacacccttctgtgggaagtcagacttggcaaagcctaagtcccccagtcccttgcatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagctgctgggcccacacaccatctttaccctctccccttccctcagtgcagacgtagaccacaggcctggaagagacgttagctgtttctatggtgttccatgagacccagttactccccagatgtgctctgtccttgccagagtagcaagtagaggaccccaagccgaagggcggccacttgtgagtgattaccagggaagcccactgtctctagcatgccagctccaaagctgagacaggaaccagggggcctctatcagaggccctgcgtgtcatatcgtgcccacaggctgttcctctttgtgtatcgttaataacttacaacgtgactgccacactgccccgaaggactgccaagggaacagaaaaggcaatggcttgagtccagtcccttttcagggcagtagcactccaaaggggcaggcatcgtgactgcaggaacatgcaagtttctaacgtgagagctgtgcagaacaccagacaacgaaaagtgccctgaccagagcgtgcaggtgtgtctcctagaaagaggcctcacctgagacgccactgtcccttagtcaacttcccaagaacagaataaaaaagggaacttccaaggctgctaaggccgggggttcccaccccacttttagctgagggcactgaggcagagcggcccctaggtactaccatctgggcacgaatgcaataatggttactaaagattcacaacgtctgggagcctgcacagggacaggagatggctgcagatgagaagagcctggctagccacagccacttaccagcggacctcaggtatcatagcctgtgggaccctgagccaaagggtttgcccaaggagaatgggcaaacaggttacagggtcctggatggggaagggggcacctgggctgccttctaacaaggacagagtctcttggtcattgcctgtccttcagctgtcactcctctgcattaaggcacacagttattagacactactaccgctatccacaaagacaggggactgtggatctcaaccagacatggctgaaccaagagaaactgaagatgtcgtgagaagctcagaaaacgccaggagaagctgaataggaatctgcctgcaaaccatcagggcaaggaggcaataacaagtgacagagccaacgagtgacagcaaggaattgccctgtgatgaactaacaacaaagctgggctgacctgggctaagctaggagtgggatctgtgctgcactgggctggaaggagccgggatgagccaagcaaagtgggttggactgagttgaattggcctggactagtttgtgttgggctgggctggcctggaataggtaggctaaaccagcttaaactagggtaggctgggcttaactgaatcagactaggctagactaagcagaactgggctgggttgaactgggctacactagcctggtctgatctaggataggctgggctaagctgagctggactggctggactgggctgagctaagttgcactggacagagctgggctggagtggactggactgggttggattgggctggactgggctgggctaggctgagctaaattgcactggacagagctgggctagagtggactggacagagctgggctagagtggactggactgggctgggctgggctgggctgggctgggctgggctgggctgggctgggctgagctgggctgggctgggctgggctggactgggctgggctggactgggctggactgggctggactgggctgggctgggctgggctgggctgggctgggctgggctgggctgggctgggctgggctgggctgggctcagcaggcctaagtaggcctagctgggtttagctaggtttggctaggtaaggctgagctagattggactggactgaaccaggtggggtatattcagctgacattgtttggtctggtctggactgaactggactgagccgggctagcctaagctagatggggggtatactcagctgagatgggctggtctggctagattgaactggactggactaggctgagccaggctgacctgagatgtcctgatctgggctgaactgggcagggctggtctcagctggactacactgagttaacctgggctgaaccagactgggctaaactaggttgtactggctggattagacttggctaaactgggcttggctaaactgagtcaggatggtctaggttgatttttagttgggctaaactaagctgaactacactgaactaggcaagactgggctggaaaggtctgagttaaattaggagggacttggctgggctgggctgggctgggccaggctgggctgagctgggccaggctgggctgagctgggctgagctgggctgagctggattgagccgggctgaactggactgagctgggatgagctggactgagctggactgggttgagctgaacaaaactaaactggaatgggctaaattggcctaaaattggctaggctaagctaagtaaggctgccctgagctgagaaggactggattggcctggactgagtttggatgagcatcattggactatgctaagctaacttgggtgaagtgggctaagcaggactaatctggcctgatctgagctagaccaagctaggccaagctcagctaagtttagcttagctgaattaggctgggctggactgtattgagctacactaaatttaacaggctgagctgagctgagctgagctgagctgagctgagctgagctgagctaagctgagctggttttgtctaaggtggattgacctgggctggactgaactcaattggactacactgaacttatctggacctcactgagctgtgctgcactgggccaaccctggatcactctagatctagcttagctggactgggctgagctagattgggtggactgatctaggctgaactagactattcttgcctgaggaaggctgggctatgctgagttgaactaaactgaactcagctaaggaaggctaagctagactgagctgagctacgttgggttgggctaaactgggctgagctatctcgggtagactaggctgagctagactaaattgggctgagctggagttggttggactggactgggttgggctaagctgagctgatttggtgtaatctgggatcaggtggcttgagctggactggactgtctgagctaaactgggttgagtggagctgagtgggtctgagtgaggctaggctggaatgagctaggctaaactgggctgaactggtttaggttgaatttagctgagatgagctgggctagacttctataagatggctgaactctgctagggtgaactgagctgtgctgagctgaacttggattaactataattagttgagctgggctgaactaggctgagtttagctggaataagagtcaactgggcccaactgagctaggctaagctaggctgaactgggatgagctagaattactgttctagtctgatctggactaaggtagactgggctggggttgagctctgttgggctaagcaaagttgagctatgagatgaactaggctgaattgggtacttctagatcattccaggctgttctgggttgacctgaactgggtgggattgagctaagtggggtaggctatgctgagctctgccaggctgcatgagtttattgatctgaactgggacaggctggaatggactggcctgagctacaccaactgggctaagctgggataggtcaggctaggaggagtcaagctggactaggccaaactattataggtcttttggtctagttgaactttctggtgcttaactgaactgtgtttaagatcgattgctcaaaccagagggaggagaagcccttggccctgccaaggctggaccccacacacacaccagtgtaggggaatgtcaggacagagaggtggaaaggggtgggtggttgggtgggggaaaagtgataacatttgaaatgtaagtttaaaaaaaatccaaaaaataaattaatttaaaaaaaaatagattgctcgaaattttttatggatgtttttaactgttctccaagaagattgtcctgatatagtagccagactatatcagggtaggtagagacaatcaggtttatcagaaatatcctatgctttctgggggcctggcacagagctgaactgggccccaggctcaggagaatgtcacgggcatgcgggcactccagaataatttaggcagccatcaaggtggcttctgaagtggttgtattctctaactgtgtgctgtctaggatctgcagaggtcactaggaggcagaacactttgcaggttagcctgtggtaaagccaagagccccatgaatctgaaaggctgagaccaatagccctaggaaacaagggtctcacagttctgtcattaatgtgtcccaaaacagatttaatgtgtctcgccaaggaactggtgctcctgggaaagctctgaatccccaggtcccaaaagtggggacggaagatacaaaagtaattcactggatctctgggttcccaagccctttggggtacctgtgtcttggatttaaagtatagcctggtccctctggcaatatcatacagcctaccttaaagctactccattcaccctgagaacctaatggcttccagtctgccacccagttctcctgcttcatttatgggcatatcagagataataccactgtcaccctgcttaaaggacagacaggaaataactaacacacacatccccaaaagttctcagtcaagaaagagagcaaagttgcctcttcctccaaagctcatacccagccctcctggaagcccctgtgctaagccagctaggggcagtgagcaaagcttggcagagcatcaataatcaggggcctccctgggtttgtgcttgggtttagagaatgaagacaagacccagaaggagactgtctcctagactggaagagaatccccagaaccctgctcctgtcacagctgccctaatcagtcccctatgctgcaggcatgcagtgatctaaacaaatctaacctaggtccttcctgtcccacagtttctgtcaaggccccttcactctatcccttgaagccctgtagcagcgaaaacacggcttcggtgacattgggctgcctggtaaaggactacttccctgatccggtgactgtgacctggtattcagactccctgaacacgagcaccatgaacttcccgtctatcggttctgatcttaagaccaccaccagccaaatgaccagctggggcaagtcagccaagaacttcacttgccacgtgacacatgccccatccacattcgtcagtgacttgactatccggggtaagcagggttgagctggttacagttaccacaagagggaacatggtcagagcagaaaggaccgctcatatatacctataacagggggccaggggacccaacatactcaggggcctggtttgaggcttgaggggacataaggttagggagatactcacagctcactgcctctgccctagctcgacctgtcaacatcaccaagcccactgtagatctactccattcatcctgcgaccccaacgcattccactccaccatccagctgtactgctttgtttacggccacatccaaaatgatgtctctatccactggctaatggacgatcggaagatatatgaaacacatgcacaaaatgtcctaatcaaggaggaaggcaaactagcctctacctacagtagactcaacatcacccagcagcaatggatgtctgaaagcaccttcacctgcaaggtcacctcccaaggcgagaactattgggcccacactcggagatgctcaggtaggcccacactcgcctgatgctgagacctcagagttctgaagggaaggcaggctcttacgcagcccttcctctcttacagatgatgagccccggggtgtgattacctacctgatcccacccagtcccctcgacctgtatgaaaatgggactcccaaacttacctgtctggttttggacctggaaagtgaggagaatatcaccgtgacgtgggtccgagagcgtaagaagtctataggttcggcatcccagaggagtaccaagcaccataatgccacaaccagtatcacctccatcttgccagtggatgccaaggactggatcgaaggtgaaggctaccagtgcagagtggaccaccctcactttcccaagcccattgtgcgttccatcaccaaggccccaggtgagcacaggagatggagagtgggccggcccttctctgtgttcagatggcacggttaactggttaactcgtgtctgcccacaggcaagcgctcagccccagaggtatatgtgttcctgccaccggaggaggaggagaaggacaaacgaacactcacctgcttgatccagaatttcttccccgaggatatctctgtgcagtggctgcaggatagcaagctgatccccaaaagccaacatagtaccacgacacctctgaaatacaatggctccaaccaacgcttcttcatctttagccgcctggaggtcaccaaggcactctggacacagacaaaacagttcacctgccgagtgatccatgaggcacttcgggaacccaggaagctggagagaacaatatccaagagccttggtaacacttccctccgtccctcccaggcctccatgtagctgtgatggggaaggtgaatggcagacatctgcccactgttgtaacactgggaagccaccccaataaacactcagtgcctgattagagccctgggtgcccttcttcggggaaggtgggttgtgggcagaagtatcttggcctgaaagaagggaaaccccaagagagggacaggagtgaagcatggctcacccatctgtctatgtgttgggtatttgacaaataggacatcacagggcttcagcatagataaccctggtccttcctgcccttcactgtatcatgcacctgaaagggatccaaagagccagagaggtggtctctagagatgtaggtaaaatgaaccaacctgagaggcctcggcacccacccctcagtcttgcaagctcctgctcccaggtattcctggatgctggaactccttaaggtagagaaacagccaaagtcaacatctggaaaggcagaagtcagcatggccctgctccttccctctgtactcagcagccattgaggctgagcctacggccctgacctcctgtgtgccatgtgatcataccagacccggatcagaacctggtgctcctcatctttcaacccaaagtcatcccaaggcccagaatgggaagccagcttcacacagttgggttctcccatctatgccatgttctcacacacacacacacacacacacacacacacagagccacaaacactcaggccaccaagtcttaaagagactccaccaacagcacacacttgcagccacctgacacaacaacacacctcacccatgttcacatgtggcctgcgctaggcttcagtctgtttccagtcctttaccttttacacttgagtccaaaataaaaacagaagacttacgccctgagggagagaccagtgtcttcttcctgtggcctcagctcccagaacactcttccctaccttctacaacactaagacagtaagatacacccacacgaacataaatacatacacacacacacacacacacacacacacacacacacacacaccccaagtaggcttcatcatgctctttggtttagcaatagcccaaagcaagctatgcatccatctcaggcccagagggatgaggagaccagaatcaagacatacccacgcccatcccacgcccaaccaccaaccaccagcacatacggttcacacacctgagaccagtggctcccatcacacacacacacacacacacacacacacacacacacacacacacacacaagcccgtacacatccaccatatccagagacaagtgtctgagtctgagatacctctgaggatcaccaatggcagagtcggccagcacctcagcctccaggccaatccttatactttggcccactgcaggccatgagagatggaggaggtggaggcctgagctgtggaaaaccagagacaggaagatggtctgtatggagagagtagtaaaccagattatagggagactgaggcaggagtagagctcctacaaggccagtagtctaccttagagtcctataagtctgggctgggagtccatgtgtcctgacttgctcctcagatatcacaaccaagattcctggagccagagtgtgcatgcaggccttagaaatggagcttagagcccttcctggagggccctgggcactctgaacaaaaggcaattctgtaggctgtatagaggcatcctgtcagatacacacacacatgcacacacatacacacacagagacacagacacacacacatgcccacacacatgcatacacacatgcacacacatacacacacagagacacagacacacacacatgcccacacacatgcatacacacatgcatgcacacacacacacatacacacacacacacacacacacacacacacacacacacacacacaccccgcaggtagccttcatcatgctgtctagcgatagcccttttgagggtgggagatactgggtcatggtgggcactggagtagaaagagggaatgagcagtcagggtcaggggaaaaggacatctgcctccagggctgaacagagacttggagcagtcccagagcaagtgggatggggagctctgccactccagtttcaccaggactgcctgagaccagtgagggatccaccctgccacactgtcacttggagtctggggacgctaactggctggtccccccatcccagagctagacatccaggacctatgtaccgaagaggtggagggcgaggagctggaagagctgtggaccagcacttatatcttcatcagcctgttcctgctcagtgtgagctatggggccactgtcactgttctcaaggtgggatcctgcacctcggtgggtgggtcagggaggtctaggccaagctgcagcgccatcctcacatacacctttcccccaggtgaagtgggtcttctccacactgatgcacgatacaccccagaccttccaagactatgccaacatcctccagaccagggcatagatgcgatgccagcacccgtgcaggcctgcagccatgtgtgtctgagcctcctgaggtgcctgtttgccttggatggtaggtgggagcagagacccctaaaggcaccagagttggtgagatgtcaacatgtagaaggtgcggcttggggcagcaatgtgggctgtcccgcatggatactttgagacaggactttgaagagcctcaatttgacctatcaaatgctggtcacccaggtctttcagcatcagggtcactccatattgactgaataaccacaaaagcacaagaacccagagcctagagtccccactaggccccacctagagcacagagtcaaagctgggacactcagaatcaacccaaagtccagacccttgctcctcagaaggaatcctgccccactgcttccagacagacctctggcctaggcagatcgtcctactgccagataaggagcctcccacagggcagcagcagactcaagctctgaggccccatcaaccccagccccagcctggcagtcctactttgtctctggtctctttagtaaagttcttttccataactcctgagagtgctttgagaaggtatttaaggctaccattatggtgatgacaggtcccaagaacatggacaaggaccagatggtaagagcctggggattaaacatccacctctatgccatcctcctcaaaccacagagttctgccccagtctccatccggtccatcattcctgctgaccagactcacctcccaggggaattgaggtggaatcagggctgggcccccgggaacctggctgcaggtcactcttcaagaccacaatctgcccacccagtaagtgcagactgacaggccagtcccctgacccaagctgggacactagagggactaggtaacagcacgcaagtgtacaagaaccatccaaaatgggttgtgccatcctcaagacatgatctcacatgacaaaagacaggcttctctcatatataatgattgctcagggactaagaagaaagacctcttcatgggacggaaaaaccagcagtcactgtttttttcctgaagaaaatgcttcaatggtgagaacacttctagaaagaaggatgttagggtgagtgtggccctgctgggccctgggtaaagaaaggcatgagaactacttagaccattttgagggtcagttggccaaacactcttgtcatcacaagtgacagtctcacaaagaggtccacactggggtgtcaagctcagcaccaggggactttgggggaactaagatagggataaaccagccgggatcaggccatagtccacaggcatctgagccctctgctgctgagtccggcttctacgggccttggagtagggcccagatggcaaagacacagaaagctacccctcctgggtgcagaagacccaggactgggagaatgactgttctgatgagaaaagaggctctgtttaggatgtgtcccaagccattagtgtggccagcttactaatgtgcattcatgctgcaaaccattgctcacaatcaaatgtataccacgcacacagtcacgtagtttgcgcagacccactcatgtggcacatgcctgtgggcacatgggaccacacatacacgtgatgctttaaaacacagatctgcacggtcttgtacttagacacacattgtctcaggaagcccaggtgtggaccaccctgtcctcctgccacattctcctaagccatatcccctgccaagctgaggcctaggtgcctcttcctcaaccagctcctagaccaacatccctgaggcatagctcagtgtcttcttctaatcactatccctccaagccacgagaccccatagacactggacacgggcagcaagggttcagctcaaagaacacggtgtggcaggaactcctaccaaatcccaactagaaggaaggaaagtcccacagagagctagactcactctagacaacccagacagtgaccctggcttctacataccatgaatgaatgaccttctgagactaagaggtcgctttcttctctattcctacattatcagtccaccatggagggctacatggaaaaccccaaaagacataatcacattttggaacccataaatgtagcctcttgggaatagttcttcatcaatgtgaccaaggtaactatctcaagacgaggtcatcaaggactagctagtggactttaacctggtgacaagagtcataagagacagaagcaggacctagggggtaaacagggcctgcattctccaaaatcaaagtgtcaaaacagaaatatggcagcaaaacagaagtaccgtgcccaacactggtcaagaccaatgggggaggctcatgaggggttgcctaacaagagcaggcacaagtgcttagataaaaccacaacctacactcggccaccgtaaccctacatagaaaatgtacctatgggacgtcagctcaacgtcagtcccacctcgttgctgtgcgcagacagctgcagcctgaataacctgtccaagtgtgcatgtcacatccttgatgacacactgtaaccagtgatgccatgttagcacgatgtcctgtgagggtgtcttctgactcgggatggcaaaccctaagaccaaaaggaggtgcttggttcacgagagcggcctcgtggctggacacatggcgttaaatgagcctctgtggactaggaagcagctttaaccagaaagactataccagcaccctgcttcacgtttccacctttgagcctctactgactaagccactggcagccactcagcctgtggtattctctaacggcaacagaaatgactaagacaggcaaccacaatgtcccccactgctgatggctccagggcattcttggcctgatgacaggacctccagagcctccttgagacaggcagatctctggagggcaggaccaagctttctcctctctacctccccaacatctttgactagcttcacagataaaaggctagggggacatcagtttattccacactttctaagtctgatgcaggagcccttcctctgcgaagtatctatccaagaacccagaaaaggctaacttccccaactcaacacttagcaccactgacacacctgaccatacccactgatttacaacctttctcccagacagggccattcctgggcaaagactgtggtgtgagggcccagagtcctattgttgtataaatgaggcacagtggcagaggcaagctacaaagagtgacattgtggagagaggacactggggacagtcggatgtgtagaggatcatatgaagggtggagccctaccctgacaatctacaaagagtgacattgtggagagaggacactggggacagtcggatgtgtagaggatcatatgaagggtggagccctaccctgacaatcttcaagaggctccataggtcaaaggcccatcctgagaaagctgtgataggaaattgactcagggcagatgggatccaaatgagggtagcacctaactgtgacctacagacctccatgttggtcctcaagttggggcacccactttctcatggacgtagccatggaggtagccacagctcgtgacaagccattccagacacttgcctcaccccgttgtcaaccctgtgacctcaaagctcttctctgaggcccccctcagcttagggacccctctggagtagccctgttactttggctccttgacaacaagctctcaggtctcccttctacccctaattgtcctctccctctccatctctgccttggagtctctgagaaactagatgttcatttcattccctcctgcatctcctgcccaacctacccctgtggccatgcatgtggagtcctggccccatccaggcccgtgtggtcagacacacctgtctccaccacagccagaccacaggccagacatgacgtggaggtaagcggccacaatgtggaggtggaacaggaagtgggtgagggaccccatccaggggccagacacacagtcgtgcagccccctcaccgctcagtctgacccatccacaggcaaccacacacagagaaaaccagtttccagccaaggcttcacccagtcctaagctctctccggtagggcagacggcctttagccatgagaatggaccttcagggtgggaccacctggccatgggaggcctggctgttcccctatgaatgacactcaacaaccttgagcaggtgggtcccggtaccatctggactgctctgctccttggtgcactggggaatctcaaccaggccagacctgagaacataaggcagagaagcattagcaaggagaaggtgattcggagagcaagaaccagaggaatacaggacatgaacacaggcacgaggcggggtcatggtctgagctgcagagaagagagaaaaatggatgaaactcagcttcctggaaagcagcaacaagagactcccaggctagactgaggcaaggataaggaggcatcaacaaagaatgggggtgactcgggctgccatggctcagctgagctggatttagccaggctgagctgaactaagcttagctgaggtgaatgagactgagctgagctgagctgggacaaggtaggccaagttgggctgactgagctagtctagactggtctgggctagtctgatctggactggtctgagctgaactgagctaagttgagctgggataaactgggctgaggtgggataagatggcctgacttgggtaactaagccagtctagaattggataaactgaactagactggtccaaactggactagactgagctggactgagttagaatgaggtggactgggctaaactgggctgagctaggttaagctagggtggactagaatgctgatttaagatggcctggggtgggaacgctagctaagccagaccaagctgggctaggctgggttaagttgagttgagctacagtaaactagcctgggctgtgctgaccttactacaccaggctgggtttggttggcatgaatggagctgatttgagctgggctagaccaggttagtatgagctatgctgtcctggtctaagtagactgggtgaggctgagaaaattcgagatggaaactggactgagatggaaaaagataggcttagtgttggcttactgaaccagtctagaatgagctgaactggacttggaatggcctgaactgggcttagcttatctagcctgggcttggctaggctggcctaacctaggctgagttgatctgaactggtgtaggctgggataggcttgctgaaatggactaggtcaagctgggctggagtggggttagctaaaataggtggactaggctgagatgagttaggatgacctgagctatatttaggggatggatgggatgggatgggctatcccaagctaagctgggctagaatgggctagtgtaagctaaactggctgggttggaatgtgctgggctgtgctaagctagaataaactagagtggactggccaaaatcggctgggacggtctgtactgaaccaggctgggctgggctaactgagctagaccggtctgaggtgagctaatctgggatggggcggactgagctgggataggctagattaagctgggatgagctaggctaggctcactgagctaggctggaatagaccggtctaagataggctgcctgagctaaactagactgagatgaactgtaatgagctgggatgagctaagctaatctgggatgatctgggctaggctggaatggactgagccgagctggtctcagctgggctgggttgtgctgaatgggggtaaaccagactaggctacccagactaagctgggctgtgctgggccaagctgggctgagctagggtgggttgggctcgatggctgggctaatccaagctaggctgagctgagctggactgagctgggctggacggagctaggatgggattgactgagctgagctggactgaaatgggctgagctgagctaggctgagattcgctgagctgggctgagctggactgagctggactgagctggactgagctggactgagctgggctgagctgagctaggctgagattcgctgagctgggctgagctgggctgagctgggctgagctgggctgagctggactgaaatgggctgagcagacctggacaatgcaaggctgcactgaactgtccggctaggctatactgggatgagctgagctgggctggtctcagctaggcttggctgtgctgcatggaggtaaaccagactaggctacccaagctaaactgggctggaccaggctgggctggactgagctgtgctgagctggactgagctgggctgggctgggctgagctgagccaggcttggtttggctgagctgagctgagctgagctggactgagctagactgagctgggctgagctgagctaggctggactgagctggactgagctgggctgagctgagctaggctgggtttggctgagctgagctgagctggactgagctgggtgagctaaggtagactggaattggctgagctaagctgagctggactaaactggactaagctggactgagctgggctgagctgagctaggttaggattggctgagctgagctggactgagctgggctgagctggactgagctggactgaaatgggctgagaagccctggacaaagcaaggctgcactgaactgtctggctaggctatactgggatgagctgagctgggctgggctaagttgacttgggctaggataaactaaactgggatgagccggggtgagctgcatgaggtaggctggaatggctgagctagactaggccaggctgagctggaatgagccgagttgagctgagctgagctgagataaacttagtaaggctagaatgaattgagctgagctaggctgggccgacctaaagttgctctgaggtaggttagacatggttgtctgagctgggctgagttaggctagctataccgtctgggctgacctaatatgcccatattagttgtaatgacgtgacctaggttgaaacgggcttgctgatctgggctggactgggccaaactggagttagtctagcctgggctgacttagtgtagcctgggcagagttagactggaatgggctacactgagctgaactaggatgggatgggaagggataggctgaactgactgagctgggttcagttggccttgctgggctgagctgggctggatagtctagctgggctggccagaatgaggcagagctaggctggaattaggctaaacttggtttggctggttaagatgagctaacataaattaggctggctgaactacactggactgtaagctagcctgggtgagttcgcatggctggacgtcttcacagctctagtctgagttttactggtttgttctcctcagtgctgaggtaatagaaagactttggagtaaatgtgaaccaactcttgtttcatgggtccagactgtggcctcagtttgtcttatatgaacggagccacgccactcagtgtccaattctcatgccctcttctccttccctgattacctggtggaaactcacatgtacctgtagatagtgcctacatggacagaaccactgctcagatttagtcctctggccttttggtccactgcttgctgggtggatgggcaggtggctggagtggtgggtctgaagccaggacaaggcaagtataaagtaaaaacacaacaaaatggcccccaccccccagtgtaacctccaagccagctgttccccaaccattcctgccctgtgctggctgaggttggccgtccctgctcaggcccaccagttctggacctcctaacctgggactgagaacacggctctacccactgcccaagcaggagtggggctcagaaatctggggcgctagactgctcaggagcatagccatgtttacaaagacactcacagtgcgtacaagccctgctggaggcatctagccagatccttgaaaaagacaacctgcaggtcacgttcaaaatctatgcagccagtcggtcagctccaactgcgggtacatgatgcaacccctatgtgatactgggcctaggttctccggtataaagaagaaaaaggcatggtcctttctccagagattgtctcaagatgggcagtgtgaggactactatctcactcatgttttatgttccagagtccgcgaaagatcccaccatctacccactgagacccccaccatctccgtcaagcgacccagtgacaatcggctgcctaattcagaattacttcccatccggaactatgaatgtgacctggggcaagagtggaaaggatataagcgtcataaacttcccacctgccccagcctctgggccatacaccatgtgcagccagttgacattgccagctgcagagtgcccaaaaggaacatctgtgaaatactatgttcaatataacacaagccccgtcagagaattgagtgtggaatgccctggtaaagaaggttgggggggtctggggtgggctaagtcctaccttaacctggtatctggacccatatacccctctgaagcacacatcccactcagaaacctcccatgggggatggggggagggggtgtgaacaggcagagggagcagaggcctcagaacatccagaaaaggggacagcaaaggagaaaaggagactattctgatttgctaaaacttctatgttacaggtccaaaaccctccttagtctgccgccctcgcctgtcactgcaacggccagcccttgaggacctgctcctgggttcagaggccagcctcacatgtactctgagaggcctgaaagagcctacgggagccgtcttcacctggcagcccaccactgggaaggatgcagtgcagaaggaagctgtgcaggactcctgtggctgctacactgtgtccagcgtcctgcctggctgtgccgagcgctggaacaatggagagaccttcacatgcacagctacccaccctgaatttgagacccccttaaccggcgaaattgccaaagtcacaggtgggcccagatgcatacctgggacattgtatgatgttccctgcttgcgtacctgctttcttcctctaatacagatgctcagctgctcaggcccttgtgtcacagagggaaactggagctatccaaagaactgcccagaagggaagggcagagaggtctctgctctccttgtctgagccataactcttctttctaccttccagaaaacaccttcccaccccaggtccacctgctaccgccgccgtcggaggagctggccctgaatgagctcgtgtccctgacatgcctggtgcgaggattcaaccctaaagatgtgctggtgcgttggctacaagggaatgaggagctgccctctgaaagctacctagtgtttgagcccctgagggagccaggcgaaggagccatcacctacctggtgacaagcgtgctgcgtgtgtcagctgaaacctggaagcagggtgcccagtactcctgcatggtgggccacgaggccttgcccatgagcttcacccagaagaccatcgaccgtctgtcgggtaaacccaccaacgtcaacgtgtctgtgatcatgtcagagggagatggcatttgctactgagccaccttgcctgcccctactccttaaataaactctgtgctcatccaaagtatccctgcacttccatccagtgcctgtccatcatccttagggtctacaaaacactgggaggggtcagggcccagggaaggaggaacccccaccacctgagcttgtaaggcctcagagactctgaaggacctacatgcctagagtatatgtgtatgcatgtatacgtattagtgagtgcctttgcgtgtgtacctgtgtgtaacaagagaggagtgagtttgtgcgtgcctacgggtttatataggtatgtatatgggcataagtgcatacgcctttaagtgtgagcatatctgtgtccccgtgagcacatgtgtgtctgtgtatgcctatgagtgtgcacgtatctgtgtatgctcatgttggtggaaacatgtgtgcctatagtgtgtgtacctgccaggtggatgtgcaatgaaagggaggtgagaatgggggtgaagtccgagatgagcagattcagccaagacaggcaaacctcaggggagagtcccaagagcagtgggttgctgcagaggtactctgaatggtacttctgaatggtggtgtggctgtctgagtataagattacagcttttgtcccaaacaagaaagggatagatggagcaagagagtagcaagaccaaggctggtactgcctgggagtcacaataggaacggtagaggagtgaggagatgaatccaaggggcactgggaagaagatgccacccaccctcagtgggccagccctgaatggagacgtgcatagccactcagggtgaccactgactcatgagaaagagacataacatggcacagacagccctcagcagcaccctgctctgcatatatgcacatgggcatacaccctggtctgcatacaggtacatgggcatacacgcacatacatttgcacactcacacagacccgaaccctggaggaggacgaagttcacagcccacacgcagcttctggaaagcaatgggagtcccctcccaagcccaaccatgacaactcatggacaagtctataagctcctccaggtggcccctttctaacctaagtctcccttcccatcctgagcccaagtataacaaaccagaaacagggtatgtggcaagctgggaaaagacaggagcaggccatagagaccactctcacacaggccttggcctcctccatgggcacccctagaacacaaagttctacaaccaggtacacttggcacccagatgcccacaagagggcagtggggcccctgctcctgtctcacgggccttcagaacctctccaggggcctggtttctagcaacttccctctgctgtcagagcaaggcccatgcacaccctggataccctccagcttgaaagtccacttccccgaggatagcaaaagcgacaggccagctttggaaacctgacccagaaaagcacgatagccacccatggaacccaaggcctggtccaaaacagaattctagtaaggaggagccaataggtgaaagactgaacacacacagggagagaagacagaggagcacgatagtcgagagaggggggctggtgggtgaggcgatgagtgagtgactggaacaaggttgggtggatatgcagatgaatgatgggaatggtggatggactgatggatggctgcagtgacagaaatatgagtgactgagtatcggcacacagtccctacctccacttaaaatcaaagttctatgcgcggagactctgagggcagtggggttgtctctaccgggagactttagtgttggttaacccccccccaagttctttataatgcaacagaatcctctgaccacatgtccaccccttggtattccaacctcggcccagaaatcaccttggcctgtatctgtttgagagtgtccgatcttaccgaaccctagtacccaggccaagttcaacctaagaactggggcttttgtgaggtgttgctaaatgtctagagaggtctgagacaagtggccttgggctcaaactcttctcagagcctcaaagacagaaacaactctcttaccatgatagttctctaattaagatcccctgagggaaagagagagagtcaggtcttggggggcatctcaagaacttcaaggattccagccccttacctgggaccctgccttctcattatcccagaacaagtcccttctcagagataaggaacccctgccaccaccgtccccaaagcccaagggggcatagaaacagaggccttaagcctgagcccccatccccatgggtttggatctagaaggtcatctatgtcttacagaatgccaagagccaccttcctacgtgatactggaccagtcacaagacatcctggaggaagagaccccgggtgccagtctgtggcccaccgctgtgaccttcctcaccctcttcctactgagcttgttctacagcacagcactcaccgtcacaactgtacgaggcccatttggcagcaaagaggtcccccagtactgaccaggagccagccacaggtggctgtcatggagacggtggggtacagggtgggggcaggggccttgaggatttactcagcccctccacatgtggccttgcaacccttcacagacatcaaggaagtggaaggaagtagaaggaaattatggcagcacttcctgggtttaacccagtcttccagaagccaggctgagacctcagcaaaagcaaagacataacccaactccaggatcctcccctctggctgaccacttgtgtctttgcacggatgaagcttggagaaagtcctctatgtttcagagactgatgtgacagcttcccacccgactcccatactttgctgagcaataaactggtgcaaaagcacagtttcttactctcaaaaacaaaagttaacaaaggattgggtgagggggtcagagatagtgtggtggtgccatgctaaactgttgcttacggtatagaatgtggcagcattgggcagggcagacacagggtgaccactgtctagtatccgagacaaccgtgtgtagctgtagccaagatgaacactgactgacttcaacaagtatttgtggcctcttcagacccaataccaggccattagcttgatctctggacctgacttctaaacatttggcctctgtgaacacccttgccaaacactggtcctggttgtgaaccttggtcctgaatactgagccttatcttggtaactgaaccataatcctgatccctgacctcagtcacgatcatgaaaccctggtcctggccactcgttccaataactggtccctagtcctgagccctgagtcctggtccaggtcactgaatcctggtcatgatcaatgggtttggtcctcattcctgagcctagtcttgatcactgatcactggttctgatcattaacaactaacctgatcactagtccccattcctaatcactgggccgcgatactgatcactgaaccctgtttctaaacaatgtgtagtgaaatgtatggtaaaacctttgcatctggctttgagtgaaatgtttcggcagacctttgctatgttttgggttagtcaggaaaggctgagaaatggttttgaggctgtttgaaccttgaagaaatgttgtctccctggacaatctgcacttggtactacattaaggtttgcagttgcacacaccttggtcctaaacactcctggcagacttagaactcttacgtttgattatggctagccatagttgaaaagggctgagagttgtatgggtggtctgctctctctcgcagcaagggcaagatgactttggtagttgaaaactttcccagccccaactaactctgtataatgtttgaataaagtaacggcagtaggctagttgtggttaatttttattccaagaagaatgaacccctctgctccttcagaaaaggaaggcttagcattttggtgagcttctctctactgaggcacctatgaccaactcagtgttctttgattcctgtcaccacatccagtcttgatcactaagtgccagtcctcatcactaaaccctggtctccaccagtctgcttgggttctgataatcagactcacattctgataactgggccctgattctggtcactagctctttgccctggtcatggacatttgaccctagtccacggcactgagttctgggcatggaccctgggccctagtcctaggtactgggttctggttctaacaactaggtcctgtactgatcaatgggccctgacctagacattgggccctggtcctcaacatcaacttctaagcctgaactctagccccaaattctgcttatcaacactggtcctggaccttggtcctcatcacacatccattctctgagacccaaggaatcagtggtattttgcaagaagtccctttgatattccaagcctcattctcattaggaagatctcttcaggggattcctgcagaaggttccagaatccccaccacactgttcacatactgggctgcaactgggacagtgaccccttttgctcatggaaacaaagcaggcccaggccctgtgagctggagcctctggcctggggtctacagatgtggggtcagcattgtggagaaggtttgcagggcaggtgtgggggtagggcagggatggtcacattagcatcttgtttttctttcttctgaagtctctgttttctatcacctgctgaaacattcaaagtagctccaagctgaggccagctgagtcatcctgagcctatctcagcccaggtgcctcaaaacagagctactgttctgagaatcacaccaccctggaccaggccaggtgggtctggggctggatgaggggtcagagccaggggagccctgacagggactgagaaggccccaacccccatcactcaaggttctccacaaccatccacagtcatgccttagtgaggccatgttctgtcccaatgagaacaagtccaattaagattaagtctggtcttcccagggtcattcagtgtcaaggagtgtcaaccaaggccagccaaggccagcctgaggtcagccagcatcacccaaggacacacaactattctagtagacaactagaatagtcagctcaacagggccctggtgatgcaaaatggagagtgtattcctgccagacagggctccacagataggctccctcactgcatatgacctccctgaatgtttcccacactgcagttggttctagactacttcttgataagcatgcagaaagataacaggataagaaattttatgcagagaacagaagtatctacggaatagaatagaagatagatagtagaagtctgctacaggccccagtggagtctctttgtagagtcaagagatcaaacctaaactgagtctcaggattgagtccagtacagaagcaaccttcaggatgctaaagaccatacaggcaatggacagaatggagtccagacagaccaatgagtggacagtccaatctcacataatgaaccatgtcaagagcagatagtgagccaaagaaggctctgggacactcggagattctcggcctctggatctcctgatgtatataccaggtgatcaagtgacagtctagtggagccattgccatcacagtgtcaggtgtcctccccttcatgggttccggtgaggatgtggcacctccctttagttggacgtgtacaataaattctcaggcctggtatgatttttaatgatccatgtgtttctatagtcttaattatctttaataaaattatagggtgacaccaaatttagggataagttatttatcaggctgtgcctttggaaggtgacgttatttacatagccaccaaggtgcccagtcatcggcccatcttccaaacggagtcaagggccatttgaaacagtgaaatccctcagggcaagggacacaacatggaggaatttaaaacagagtacagcttgatcttaacacacacacacacacaaacgtaagagatggaaaaggggatcaagggacacagaagtacagagaaaacaagacagtaagggatgtagagatgagaggtaaccacagggaaaggtgagacacaaagacgagaggagaaagacacagggacagaaagacccatgcaagcaagagagacagacataaggaagaaaaggcgagaagagacagacaaaggtgcagcaatgtggcccacctggtactcacaagaaggccctggcacacactccgatgagagccatgcacctacaaacacgtagacacagctccacacagacacacacggcatctgcacaactgtctgaacctcaaacaggtctgcccactccctctcctccaggcctttgtccttaggaaggcacgctgagggtaactcagtcgggatacttctgattggggctcactgaacagcctgaggctgggtccacagttgctctcactgtctggccctgtaccccaggtcatgcttcagagggaattaactgaatgcagtaaacaccgtctgtggtcagcatgtactaagggatagaaccctatcaggatttgtccaactaaggtccaaatacagagtgaagaagacgatgggggagatcagatggcagatgggagcactctggatagagctcagggatatggtggctgaggaacattacagctgccaggcttggcctttcatctcagctctaggtcaaggggaactacccaggtctctgctttgttgctggtaactatacctaagtctaagaacctcagtaagacacagaaccagtaagacgacagcctccatcgataagaaagaaaggagaaaggcagaatggataagtctctggacagatgagagcctacacccaaaaacagttcgttcagccagttaatagggtgtagccctagcacacgagagaaaacagttccacaggtgtaagggagtaaatctgtgcgaaggggtactgcttgagctcctcatggcctggtccagaagcagaagctgggcaggggcaaaggacagggtaaggcagggagacaggggcatgaaggagcctttgggactgtgtggtgagaactaggctgtgcttttactgagcctgagtttgtggcagttgcctcatggggaaggcacccagaggtaaggcagaggaaaggagtaactagggctgagggcaccacagggtctgaggaattagaggcagctatgacccatttgtcatggtatttggacatgtacttcatggacacagatctgagaaccaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgtgggtggggacaagctgtagagtgtccccatgaggggacaggctgagatagggactgaagtccatctacaggcttaccacactccatgctctggatgagagcactgagctctgccaccctacaacagcaggcagagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctgggaataacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctagggaaagcttttatttccccttgaattttaatcattgtctgggtgtaataccctgggttgagagctgtgttctttcagaacttggactacgtctatccaggcatctggctttaaagtttctactgtggggctgcagagatggctcagtggttaaccacacatttcttcttgcagaggacttgggcttgattcctagtacctccgtggcagctaagaaccatctgtgactccaactgcacaggattcgatgcccttttctggaggtcatctggagtagtcagctcaacagggccccgggatgcagcatggagagtccatgctgacaggcagggctccacagagagagaaagacagaaacacaggccactgaaagagacagtaatggactgaggggacagagagaaacacacggacagacagacagagataacaaaacaccgacactcatagacacagagaagagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcgattcccagcaggctcatggcagctcatactgcaatcccagttccagagtgccctgaaggatccttcatgcatgtggagcacagaagcgctctctctctctctctctctctctctctctctctctctctctctctctctcagatgaaagccatgaaccagaagacagagacatgagtgaacactcctcagagacatagccacagcactcacacccagttccacacagacacatacagcacctgcctgcctgatccaaaccccaaacccattgacccactccctctcctccaggtctttgttctcagagtagcacactgagggtagctcagcctggatacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtcttcctggcacagtctatccctggtgcaggcttcaggtcaggcccaagtgtgaagagtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcctatagcagggcatgcctctgggcatcagggagtcacacagaggcaggtaagactctagacctggggactgagaggggaaggcatgtacaagagggcctcatccttaggacacagggattcgaggcctctggatagccagtgagcaacatatgcagagtgatgaggccccaggagtctaatggacgccaggaggtcacagagctagaggcctggagggctagagtctgtgggaagggggactgcttaggttcttcccacccatgtccaggagcagaggctgggcagggccacaggacagggtaaggcagggagacaggggcatgaaggagcctttgggactgtgtggtgagaactaggctgtgcttttactgagcctgagtttgtggcagctgcctcatggggaaggcacccagaggtaaggcagaggaaaggagtaactagggctgagggcaccacagggtctgaggaattagaggcagctatgacccatttgtcatggtatttggacatgtacttcatggacacagatctgagaactaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgcgggtgggaacaagctgtagagtgtccccatgaggggacaggctgaggtagggactgaagtccacccaaggctcaccacactccatgctctggatgagagcactgagctctgccaccctacaacagcaggcagagcggcctccatgctaggaaagccaggcagcagggacagagttcctggatgggacaggtggaattgtctctgctctgcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctaggggaagcttttatttccccttgaattttaatcattgtctggctgtaataccctgggttgagagctgtggtctttcagaacttggactttgtctatccaggcatctggccttaaagtttctactgtggggctgcagagatggctcagtggttaaccacacatttcttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagagatagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctctctctctctctctctctctctctctctctctctctacactgtccccatgaagggacacgctgacgtacggactgaagtccacccaaagctcaccacactccatgctctggatgagagcactgagctctgccaccctacaacagcaggcacagcggcctccatgctaggaaagccaggcagcacggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaagcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacnnnnnnnnnnnnnnnnnnnnnnnnnnnnnnnnnnnnnnnnnnnnnnnnnncagtggcacacacacatacacacacacacacacacacacacacacacacacacacacatacactctaatgaaggcagtggcgcacacacacactctcagatgaaagccatgaaccagaagacagagacatgtgtgaacactcctcagagacatagccacagcactcacacccagctccacacagacacatacagcacctgcctgcctgatccaaaccccaaacccattgacccactccctctcctccaggtctttgttctcagagtagcacactgagggtagctcagcctggacacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctgggacagtgtccctggtacagtctccctggtacagtctccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtctccctggtaaagtctgtccctggttcaggcttcaggtcaggcccaagtgtgaagggtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcgtatagcagggcatgcctctggacatcaggaagtcacacagaggcaggtaagactctagacctggggactgagaggggaaggcatgtacaagagggcctcatccttaggacacagggatttgaggcctctggagagccagtgagcaacatatgcagagtgatgaggccccaggagactgatgggcaccaggaggtcacagagctagaggccgggagggctagagtctgtgggaagggggactgcttaggttcttcccacccatgtccaggagcagaggctgagcagggccacaggacagggtaaggcagggagacaggggcatgaaggagcctttgggactgtgtgatgagaactaggctgtgcttttactgagcctgagtttgtggcagctgcctcatggggaaggcacccagaggtaaggcagaggaaaggagtaactagggctgagggcaccacaggatctgaggatttagaggcagctatgacccatttgtcattgtatttggacatgtacttcatggacacagatctgagaaccaggcctggctctcactaaccggcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagggtgcgggtggggacaagctgtacagtgtccccatgaggggacaggctgaggtagggactgaagtccacccaaggctcaccacactccatgctctggatgagagcactgagctctgccaccctacaacagcaggcacagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccatgtcctctggagagctgcctactgtcacagatacctttcttctgtttctgctaggggaagcttttatttccccttgaattttaatcattgtctgggtgtaataccctgggttgagagatgtggtctttcagaacttggactttgtctatccaggcatctggccttaaagtttctactgtggggctgcagagatggctcagtggttaaccacacacgttgttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagacagacagacagacagacagacagagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctcgctctctctctctctctctctctctctctctctctctctctctctctctctcagacacacacacacacacatacacacacacacatacactctcaaatgaaagccatgaaccagaagacagagacatgtgtgaacattcctcagagacatagccacaacactcacacccagttccccgcagacacacaaatcacctgcctccctgttccaaatcccaaacccattaactcactccctctccttcaggcctttgatttcagagtagcacaccgagggtagctcagcctagacacttcccatgggacctggttacatagcgtgcacagggccacctcttgttggccctataacccatgtgatgattcaggaaaagatgttgtctgagagcagggcctggtacagtccccctggtacagtccccctggtacagtctctctggtacagtctccttggtacaggcttcctgatacagtctctctggtacagtctctctggtacaatctgcctcgtacagtctccctgatacagtctgcctggtacagtctctctggtacagtctgcctggtacagtctccctggtacagtctccctgatacagtctgcctggtacagtctctctggtacagcctctctggtacagtcggcctggtacagtctccctggtacagtctccttggtacagtctccctgatacagtctgcctggtacagtctgcctggtacagtctctctagtacagtctgcctggtacagtctgcctgatacagtctgcctgatacagtctgcctggtacagtctccttggtacagtctgcctggtacagtctgcctgatacagtctgcctggtacagtctctctggtacagtctccttggtacagtctccctgatacagtctccttggtgcagtctccctgatacagtctctctggtacagtctgcctggtacagtctccctggtacagtctccttggtacagtctccctgatacagtctgcctggtacagtctccctggtacagtctccctggtacagtctgcctggcacattctatccctggtgcaggcttcaggtcaggcccaagtgtgaagggtgcagaagacagtgggcagagctgagagagcgctagtcagttttgttcagagaacagtgatggctgctccaggctactggacatcccaggtgtgcttcttacacttctcaaagctgtgggaacacaaccaaccctctacccaattcattgtaattgtctatagcagggcatgcctctgggcatcagggagtcacacagaggcaggtaagactctagtcctggggactgtagaaggtatgtaagtacaacagggcctcatccttggaacactggtgtctcaggcttcaatacagccagtgagaaacacatgcagagtgatgtggccccaggagactgatgggcaccaggaggtcacagagctagaggcctggagggctagggtctgtgggaagggggactgcattcactcttcctatgcttgcccaggaacaactgtctatgcagggccacaggacagggtaaggcagggagacaggggcatgaaggagcctttgggactgtatgatgagagtctaggctgtgctctgactgagcctgagtttgtgacagctgtctcatgaggaagacacccagaggccagacagaggaaaagagtaatcagggctgagcggaccacagggtctggggacgtggaggtggctggcctggctcccacaggccctcagatggagctgcacatcatcccatagcatatcactctggagggcttatcaaaatggttgtgctgtgggactgggtttcaggactgaggcctgagatactgggtagcagaacatgttcagtatacagggtgctcagagtacgggggggggggggacaagctctgcagtgttcctccatgttgggacaagcagaaagaggtcttgaagctgtttgtccatccataggcctaacccatactggccctgctcatggccctagcttgggccacatatctagtgcccactgaatcatcaccatgaagactgttggaaaaccagagcctctgatgtcttcctgccttgcttgctctccctgactctcatagctcacacaggctctgccctggtccaccactgtcctcaactgtaaaccatgccaggcacagagagcaaggaatgtggtggtctcagactgtcacacacaacaatcttgtgcctttcacatccacacgcacaagcatgctcatacccctctgtcaggggtcagtggggtcttccttgggctcactcccatttctagctgctccttggtattggtgactgcggctgctgtgtcggtggctgccagagatgcttgatcggcatgacctcagatataggaatggcctggggtcaacagagtgcacacacttagggcactggccagagttctatgtagaccaaggcctctcttcctagtgtgttatttcacaaaaccttatgcaacaacatcttctattccttttattcctctttgtctgctaatggggaattttctagaaagagtgtcccctctctgtcttcctgctgtgtagacagatcttgtaggtgtgatcacagagtggtgtttcccttcttggccattttcaggccaggaactcagggccagagacagaaagtcaggaaggtaggaaagacagggagacataataaaggtgagatggagacagagaaagacaaagggagaaaagcacaggattgcagggagagacaaggagacgcccgacggaaacagacatcagggaaaagacatgattgttcctttagtaaattgctttccggagaaaagagacagcagagagacatggataggcacacaaagatacaaggagagagacaggaaacagagaaagagagaaacagagatggagaaacaacgagggagagagaagagtagagagaaagacacggagaaaaaaaatcaagaaacagaaaagacaaaagataggaagacagagaaataggccagaaatacagacagacagagagatgcctgaagatgttctctctcacctagagaaagaaagcacaggcagagataatacagagagagagagagagagagagagagagagagagagagagagagagagagagagagagaggagagaaagaggagagacacggtgttagaggagaaagcattatgttttgatagagacagagatacagcaactgaggaacagactgagcagaaagaatcccactcagagagagacagaggctaagctgggagaggcaggggtggccagagagggagacagaggagagcctgtgggacaggtcagacaccatcttggaagacccagtgacaagccagggaggtgacaggttagtgcagtttctaccccacagtccacaggctggagccacaggcctgtgtccatgtggccacaggctagctcccagcctgccaagcctgtctgtggagggattgcggagtggggctgggctgaggcaggccaggatttttccagtggagcagccagtgactgggctgagggtcactgcccaccatccccgtgattctgggtagacccaggacctggagcacacacagccttcctgtctctcccacttccctggggtgtttggaccttgcctatctcctgtcattccctcctagggtcagattccagcagtgtcgataaatgggaaaacactgaattcaatgtcaccgttaggggtcatggaacccccagccccatccccaaagctggtcaacctggccagggtggggtgaacctgcagctgcaggtgggggaatcattgatgctatttttggctcagagaatgagaaacatgtttttctgcatggaacaaacatccatttgcatgtgccccgagggccaaccctgcacagagtgagtcactcggcaggtgtgtgtgtgtgtgtgtgtgtgtgtgtgagagagagagagagagagagagagagagagagagagacagagacagagacagagacagacagagagacagagagacagagagagagacagagagagacacacacagagacagagagacagagagagacagagacagagagagacacacacacagagacagagagacagagagagagatgttgtgagcaagccctgtttcaggtactgatatctgtgcccccgtgccccagcccatgtggaaaaactacccttaggggcccattaactcatcacagtccaggccatcatggtgagccctagctgacctaagcaggttccaccctaaacatgaaggaaaataataaaggccatctgttacccagaatcctagggatggtgggcagtgaccctcagcccactcctggccgctccactggaagaatcctggcctgcctcagcccagccccactccgcaatccctccacagacaggcttggcaggctgggagctagcctgtggccacatggacacaggcctgtggctccagcctgtggactgtggggtagaaactgcactaacctgtcacctccctggcttgtcactgggtcttccaagatggtgtctgacctgtcccacaggctctcctctgtctccctctctggccacccctgcctctcccagcttagcctctgtctctctctgagtgggattctctctgctcagtctgtcagccatagttggagagagtccatctatgtttgcctctgtctctgccaattccatcagaggtctctctactaacacttgcctctgcatgtgtctcttggtccttctcctgtcttcccatctctctatctcctcatctctctgtctttctgttactccctgtctctgtctctctgtcttttctctcactgtctttatctctctgcctgtttcatggacttttctctgtctctctgtctctgtctctctgtctctctctctgtctctctctgtctctgtctctctctgcccctatctcttggtctctatctctatcttcaactccctatctttgttcctcatactcacatttacctctttcccaagcccccagtctccaggtctgcctgtttctgtctctcccttgccatgtttccctgttttattctctctcctcctgaatgctctggcttgaaactggccaagaagggaaacaccactctgtgatcacacctacaggatctgtctacacagcaggaagacagagaggcgaccctctttcaccctacagtgtctggacttggttgattccaggttactcctatactcaagtccgggactatggtggtcaagcatctctggcagccactgggacagcagctatagccaccaacatcgagccctgttagctaccaacattagctcctcaaagaggttgggtctataggcctctggtgtgaggagatgttgacagtgagaattagttcccaaggaggacaccactgtttcctgttagatggagaactacagtgggtacgaacatgcttgaacacatgagtgtcaaatgcacaagactgttgggtgtgtcacccttcccctctctgttcatggcatgactgcacactgaacacaatggtggattgggacagagtctgtgtgagttgagaatcatgaagagtgtagacacttcaaggatagtgtagacccttctagttcgtggtgatggctcacttggcactgagtttctgaccccacagggaccatggacaagggcagtatgggctgtgcctatggatacaaaagagacttcgaagcctgtattagcctgtcccctcatggaggaacacagcacagcttgtctctacccacactctgagtactctacgtcctggacacctctgtcacccagtgtcctaggtcccatccttggctcccacatcacatctgcctttcagacagatcttccagtgtgacagacccatttcatggtgctgaacaacataaacccatttcctgagggttggtgagagccggcctggttctcagatctgtgtccatgaagtacatgaccaaataccatgacaaatgggtcatagctgcctctaattcctcagaccctatgggccctcagccctggttactcctttcctcggcctggcctctgggtgccttccccatgaggcagctgccacaaacccaggctcagtcagaacatagcctagttcctaccatacagtcccaaaggttgcttcatgcccctgtctccctgccttagcctgtctgtgctcctgcacagacaagagttcctgggcaagcataggaagagtgaatgcagtccctcttccaacagaccctagccctccaggcctctagctctgtgacctcctggtgtccattagactcctggggcctcatcactctgcatgtgttgctcttgtacatgccttcccctctcagtccccaggtctagagtcttacctgcctctgtgtgacttcctgatgtccagaggcatgccctgctatagacaattacactgaagtgagtagagggtcggttgtgttcccacagctttgagaagtgtaggaagcacacctgggatgtccagtaacctggagcggccatcactgttctctgaacaaaactgactagcattctctcatctctgcccactatcttctgcacccttcacacttgggcctgacctgaagcctgcaccagggacagactttaccaggcagactgtaccaggaagactgtaccagggagattgtaccaggcagagtgtgccaggcagactgtacaaggcacactatatcagagagactttaccatgcagactgcaccagggagactgtaccagggagactgtaccagggagactgcaccagggagactgtaccaggccctgatctcagacaacatcttttactgagacatcacatggattacagggccagcaagaggtgggggctgtggaccagaggctcatactgtgttaccaggtcccatgggaagtgtccaggctgagctaccctcagtgtgctactctgagaacaaaggcctggaggagagggagtgggtcaatgggtttggggtttggatcaggcaggcaggtgctgcgtgtgtctgtgtggaggctgggtgtgagtgctttggctatgtctctgaggagcgttcactcatgtctctgtctctggttcatggctttcatctgagagagagagagagagagaaagagagagagagagagagagagagagagagagagagagagagagcgcttctgtgctccacatgcatgaaggatccttcagggcaccctggaactgggatttcagtatgaactgccatgaacctgctgggaattgaatctggattctctgtgaaagcatccagtgctctcaacccttttggggtctctgtctcttgcagtgtctcctctcagactctgtcttctggagtcactctctgtatgtattgcctctgtgtctctctcacctcctacccattgctctcaaaacttccctgtcccctctgttctctgtgtctatgagtgtcggtgttttgttatctctgtctgtctgtctgtctgtctgtccgtgtgtttctctctgtcccctcagtccattactgtctctttcagtggcctgtgtttctgtctttctctctctgtggagccctgcctgtcagcatggactctccatgctgcatcccggggccctgctgagctgactactccagatgacctccagaaaagggcatcgaatcctgtgcagctggagttacagatggttcttagctgccacggaggtactaggaatcaagcccaagtcctctgcaagaacaacgtgtgtggttaaccactgagtcatctctgcagccccacagtagaaactttaaggtcagatgcctggatagacaaagtccaagttctgaaagaccacatctctcaacccagggtattacacccagacaatgattaaaattcaaggggaaataaaagcttcccctagcagaaacagaagaaaggtatctgtgacagtaggcagctcttcagaggacacggggagtaatgcctcagactgaagagaaacacccattcacatgaggggacaggggctaaatcaagcgtgaggaggtgtggggatggaaagtaatgggtggcaggaggcttagccccagtgaagggttcctgcattcaaatctgcaaacctccacacaagaaaaaaataatatgaggggacgtagaacacaggcagcttgaaaatggaggatgcttttagcattaaagatttacagtgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattcctctttttttggcggccgatggcggttatattccttgcgtctcccgtatccagaaataataatcattcaaaacggtgttctcctcagccagtgtatgccttttggattttgcttccagcagcaccgagtggagaggagaggagaggagaggagaggagaggagaggagagatgttcagttatccaaaactaaggatccatgaagaagccttatggaaatccactattttgtaaatgaactaacatttattaaggaattttaactcagtgtatggctgggtgaacagtgttgttcccagaagaaatgggttagattgtgtgtggtggcacaggctttactcccagcatttattagaaggcagagacaggaggatgtcccaagtttgaagccagcctggtctacacagggtgttctaggatacccaggactacacagaaagcccgtgttatacatagagagatgtaagttgtcacatgaaacatggaggcctacaagttattgatcaggaagtctccagaggaatccaaacaaagcaggctgttcattgactatgttcctggctgtccaccatgactagacagtaagaccttactgctgaaggtccacttagtttgatgccgagcagagacaattccacctgccccatccaggaactctgtccctgctgcctggctttcctagcatggaggccgctgtgcctgctgttgtagggtggcagagctcagtgctctcatccagagcatggagtgtggtgggcctgtggatggacttcagtccctatctcagcctgtcccctcatggggacactgtacagcttgtccccacccgcaccctgagcactctacattctggacacctctgtcacccagtgtcccagaccccaggcctgggctcccacctcccaacatcagcctttcagacagatcgtccagtgtgagaggcccatggcatggtgtgctgaaagacctacagccacaagtgggacacctcctgccggttagtgagagccaggcctggttctcagatctgtgtccatgaagtacatgtccaaataccatgacaaatgggtcatagctgcctctaaatcctcagatcctgtggtgccctcagccctggttactcctttcctctgccttacctctgggtgccttccccatgaggcagctgccacaaactcaggctcagtaaaagcacagcctagttctcatcacacagtcccaaaggctccttcatgcccctgtctccctgccttaccctgtcctgtggccctgcccagcctctgctcctggacatgggtgggaagaacctaagcagtcccccttcccacagactctagccctcccggcctctagctctgtgacctcctggtgcccatcagtctcctggggccacatcactctgcatatgttgctcactggctatccagaggcctcgaatccctgtgtcctaaggatgaggccctcttgtacatgccttcccctctcagtccccaggtctatagtcttacctgcctctgtgtgactccctgatgcccagaggcatgccctgctataggcaattacactgaagtgagtagagggtcggttgtgttcccacagctttgagaagtgtaagaagcacacctgggatgtccagtagcctggagcggccatcactgttctctgaacaaaactgactagcgctctctcagctctgcccactgtcttctgcactcttcatacttgggcctgacctgaagcctgcaccagggatagactgtgccaggcagactgtaccagagagactgtaccaggcagactgtatcagggagactgtaccaggcagactgtatcagggagactgtaccaggcagactgtatcagggagactgtaccaggcagactgtaccacacagactatactaggcatcttgtaccagagagactttaccaggcagactgcaccagggacactctaccagggacactgtaccagggacactgtaccagggacactgtaccaggccctgctctcagacaacatcttctcctgagacatcacatggattacagggccaacaagggatgggggctgtggaccagagatgcttgctgtgtctccaggccccttgggaagtgtccaggctgagctaccctcagtgtgctactctgagaacaaagacctggaggagagggagtgggttcatgggtttggggtttggatcaggcaggcaggtgctgtgtgtgtctgtgtggagctgggtgtgagtgctgtggctatgtctctgaggagtgttcacacatgtctctttcttctggtgcatggctttcatctgagagagagagaaagagagagagagagagagagagagagagagagagagagagtgtgttgctgccttcatttgagtgcttggtgggctccatgctgtacctctgccttccctgtgtgtctgtccttttgcctctcccttcctttggcctgtctctcttgtctgcatctgtctctcttgtctctccctctctgtgtctcttttctctcctgtctctgtgtctcttctttcctgtggtctctcctcatccccatgtctgcatcagtgtctatcagtctttaactctgtgtcctcttgttcccatttctgtccctctggatatttctgtctttctgtgtgtctgtcctcatctctcccagcgtccatgtctttgtgtccctttgtccccacacagtatcttctcaaatactctgtgtgcctggtcccctgtctctcattccttttctcactgctcccatcagtgtttctctgtgtctctgcttctgtgtctctgtgtgtctgtctcatgctatctctttctctctcattatctctgtctccctcagacttctctgtctttcttggtctctgtctccctctgtgtctctgtctttctgcatgtctaatgtctctgtgtctcccttagctcatctctgtctctctcaatattcccacaatcccctttattctttgtgtctctgtctctgtggtgtctctttctcagtctctctgtatttcgctctgtctctcagaatctctgtgtccctcatattatttttcgaagtgtctccctatctctttcagtaacactatttctgtttttctcagtctctctctctctctctctctctctctctctnnnnnnnnctctctctctcagaaagtctatggcacctcttctatgtgtgtcccactctggacctggatcaatcttccttcttggacctcagtttcatcagttgtgagacgataccttgccagaagtccagaggactgtctgtcctccatagtctagaccacctgtgatctgagagatattgggacaacggatgtgcagtgagggacctgcctttctgtggagccctgtctggctggaatacactctccattctgcatcaccagagccttgttgagctggctattctagttgtctactagaatagttgtgtgaccttgggtgatgctggctgacctcaggctggccttggctggccttggttgacactgaatgaccctgggaagaccagacttaatcttaattggacttgttctcattgggacagaacatggcctcactaaggcatgactgtggatggttgtggagaaccttgagtgatgggggttggggccttctcagtccctgtcagggctcccctggctctgacccctcatccagccccagacccacctggcctggtccagggtggtgtgattctcagaacagtagctctgttttggggcacctgggctgagataggctcaggatgactcagctggcctcagagtggagttattttgaatgtttcagcaggtgatagaaaacagagacttcagaagaaagaaaaacaagatgctaatgtgaccatccctgccctacccccacacctgccccgcaaaccttccccacaatgctgaccccacatctgtagaccccaggccagaggctccagctcacagggcctgggcctgctttgtttccattcagtgcctctgggaaaggcagatgagtaaaggggtcactctcccagttgcagcccagtgtgtgaacagtgtggtggggattctggaatcttctgcaggaatcccctgaagagatcttcctaatgagaatgaggcttggaatatcaaaggtacttcttgtaaaataccactgattccttgggcctcagagaatggatgtgtgatgaggaccaaggtccaggaccagtgttgataagcagaatttggggctagagttcaggcttagaagttgatgttgaggacctgggcccattgatcagtacagaacctagttgttagaatcagaacccagtgtctatgaccagagctcagtgatagggaccaagtcccaaggccaaatgatcaagaccaggacccagttgccaggaccaagatccaggtttcacaaccaaacctagttacgcagaccagaaaccattcgttggaatctggatctgaatcagagcccaatcacactactctaaaccagagttcagtgttgaggaccagggtacgtgatgagcccaagattcagagatcaagaggtggattcagtaattaagaccaggattcagagatcaggatcagggctcagttagcaggatcagggctcagtcatgtggtcatgggctcacggtccaatgtccatgcccaaaacacaactaaggacccagtggtcagaaccaaggcctgatgatcagagacaatacacactgctcagagctgaatttcagtggcaaggatgaagacataatgataaagactagggatcagtgagcagaaccagcgatgaggacccagacgcatctctgaagactagagtcagtgaccatgaccagttcaacgatcatgagtaggacttaattctgatcatacgagttcagtgatcacgaacaaggctcagtgatcatgacaagggctcagggaacaagagtgaggctcagcgatgaaaactggacctcagttatgagcccagtgatgagtaaccaggtctcggtcattagggccaggattcagtgataagaaccaagggtctctgcagggctcagtgcatcctctccccctgagactggacaaagccgcccagccacagggatggattctccagacaggcaacagcttcagggacagcccccccgtgatgcgccagagtaggggatacccaggggacttccacactctcaaagaagaaggggagaatggaacatgaagaagggactgtgaggggggaccgggaagtgggggacacagtgactgggatataaagtgaataaataaattaatggaaaatatcacatgggtgtagggaattttgaaagaataaataaaatgttaaaaatgaaaagaaaaaaagaccaagggtcaatgatcagggtgataataaataaataaataaataaataaataaataaataaataaataaataagaaaggaaagagagaaagaaaggaaggaagaaagaaagaaagaaagaaagaaagaaagaaagaaagaaagaacaaacgaactgaatgtcagaatttagggtaagatctcagtgatgaggatcagggatcagtggtttgaacgcagacacactgcccagggccattgttcaatgacgagagtcagggatcagctatcagaaccagggccagtaacgaaagccagggcccagtgaccccaaccaaaaaccagtgactaaaaccaaataaaatagaaactaggcagccacgatggtgcacacctttaatcccagaactcaggagtcaggggcagggggagttcaagacaaccctggtctacacagtgagttccaagacagccagggctacccagagaaaccctgtctagataacaaagactagaaaccatgagctcagtgatcagtggcagttcttgatgactaagaccatggtcaagaggactgatcagcaggactcagtggttagactcaggacatggtgatgatagcctctgttccagggatcagaaccaaggccaagggccaaggccatgactgagtcatcagaacagggcctctccatgagcactagtcaggcgcagccaggcctagcatgtcaatcaggcaaaattgggtatgtgtgtggtggtatgactgactatacatcgtcttagtatctgtctgaccccaccaccatcttccctgcctccgtccactcacagatctctgacgcgtcaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgaaccccttgcggcc

SEQ ID NO: 12 - DNA, 27 bp, Artificial Sequence
  Description of Artificial Sequence: Synthetic primer
ggggccaaggccccgagagatctcagg

SEQ ID NO: 13 - DNA, 25 bp, Artificial Sequence
  Description of Artificial Sequence: Synthetic primer
cactgggttcagggttctttccacc

SEQ ID NO: 14 - DNA, 31 bp, Artificial Sequence
  Description of Artificial Sequence: Synthetic primer
gtggtacagaagttagaggggatgttgttcc

SEQ ID NO: 15 - DNA, 30 bp, Artificial Sequence
  Description of Artificial Sequence: Synthetic primer
tcttctacaagcccttctaagaacacctgg

SEQ ID NO: 16 - DNA, 25 bp, Artificial Sequence
  Description of Artificial Sequence: Synthetic primer
agcacaatgctgaggatgttgctcc

SEQ ID NO: 17 - DNA, 26 bp, Artificial Sequence
  Description of Artificial Sequence: Synthetic primer
actgaccctgatcctgaccctactgc

SEQ ID NO: 18 - DNA, 24 bp, Artificial Sequence
  Description of Artificial Sequence: Synthetic primer
aaacacccctcttctcccaccagc

SEQ ID NO: 19 - DNA, 24 bp, Artificial Sequence
  Description of Artificial Sequence: Synthetic primer
cgctcatggtgaaccagtgctctg

SEQ ID NO: 20 - DNA, 25 bp, Artificial Sequence
  Description of Artificial Sequence: Synthetic primer
gctatttaagacccactccctggca

SEQ ID NO: 21 - DNA, 24 bp, Artificial Sequence
  Description of Artificial Sequence: Synthetic primer
aaaacctgcagcaaggatgtgagg

SEQ ID NO: 22 - DNA, 27 bp, Artificial Sequence
  Description of Artificial Sequence: Synthetic primer
gctccttcagcacatttcctacctgga

SEQ ID NO: 23 - DNA, 28 bp, Artificial Sequence
  Description of Artificial Sequence: Synthetic primer
ccatatatggcaaaatgagtcatgcagg

SEQ ID NO: 24 - DNA, 30 bp, Artificial Sequence
  Description of Artificial Sequence: Synthetic primer
ctctgctgctcctcaccctcctcactcagg

SEQ ID NO: 25 - DNA, 30 bp, Artificial Sequence
  Description of Artificial Sequence: Synthetic primer
gagagtgctgctgcttgtatatgagctgca

SEQ ID NO: 26 - DNA, 31 bp, Artificial Sequence
  Description of Artificial Sequence: Synthetic primer
tggctcactctcctcactctttgcataggtt

SEQ ID NO: 27 - DNA, 30 bp, Artificial Sequence
  Description of Artificial Sequence: Synthetic primer
gatggttaccactgctgtcccgggagttac

SEQ ID NO: 28 - DNA, 32 bp, Artificial Sequence
  Description of Artificial Sequence: Synthetic primer
atccctctcctgctccccctcctcattctctg

SEQ ID NO: 29 - DNA, 32 bp, Artificial Sequence
  Description of Artificial Sequence: Synthetic primer
tgatggtcaaggtgactgtggtccctgagctg

SEQ ID NO: 30 - DNA, 18 bp, Artificial Sequence
  Description of Artificial Sequence: Synthetic primer
aacaagtgcgtggagcag

SEQ ID NO: 31 - DNA, 23 bp, Artificial Sequence
  Description of Artificial Sequence: Synthetic primer
gtactgttgacattgcgaagagc

SEQ ID NO: 32 - DNA, 21 bp, Artificial Sequence
  Description of Artificial Sequence: Synthetic primer
tggttgacatgctggctagtc

SEQ ID NO: 33 - DNA, 20 bp, Artificial Sequence
  Description of Artificial Sequence: Synthetic primer
tgtctggctggaatacactc

SEQ ID NO: 34 - DNA, 90 bp, Artificial Sequence
  Description of Artificial Sequence: Synthetic primer
aaatgagcttcaaattgagaagtgacgcaagcatcaatggtataatgtccagagttgtgaggccttggggactgtgtgccgaacatgctc

SEQ ID NO: 35 - DNA, 90 bp, Artificial Sequence
  Description of Artificial Sequence: Synthetic primer
ccagcactgttcaatcacagtatgatgagcctaatgggaatcccactaggctagtctagtcaccacattaaagcacgtggcctcttatcg

SEQ ID NO: 36 - DNA, 20 bp, Artificial Sequence
  Description of Artificial Sequence: Synthetic primer
tgaccattgcttccaagtcc

SEQ ID NO: 37 - DNA, 25 bp, Artificial Sequence
  Description of Artificial Sequence: Synthetic primer
gaggaaagagagaaaccacaggtgc

SEQ ID NO: 38 - DNA, 25 bp, Artificial Sequence
  Description of Artificial Sequence: Synthetic primer
cacccaagggcagaactttgttact

SEQ ID NO: 39 - DNA, 28 bp, Artificial Sequence
  Description of Artificial Sequence: Synthetic primer
tgtccaggtatgttgaagaatgtcctcc

SEQ ID NO: 40 - DNA, 26 bp, Artificial Sequence
  Description of Artificial Sequence: Synthetic primer
tggactctgttcaactgaggcaccag

SEQ ID NO: 41 - DNA, 24 bp, Artificial Sequence
  Description of Artificial Sequence: Synthetic primer
ggccttcatgctgtgtgcagacta

SEQ ID NO: 42 - DNA, 27 bp, Artificial Sequence
  Description of Artificial Sequence: Synthetic primer
caggtcgcactgattcaagaagtgagt

SEQ ID NO: 43 - DNA, 26 bp, Artificial Sequence
  Description of Artificial Sequence: Synthetic primer
ttcaggcaggctcttaccaggactca

SEQ ID NO: 44 - DNA, 28 bp, Artificial Sequence
  Description of Artificial Sequence: Synthetic primer
tgctctgacctctgaggacctgtctgta

SEQ ID NO: 45 - DNA, 23 bp, Artificial Sequence
  Description of Artificial Sequence: Synthetic primer
tcacgtgactgtgatccctagaa

SEQ ID NO: 46 - DNA, 23 bp, Artificial Sequence
  Description of Artificial Sequence: Synthetic primer
cactgttatgccaactgaacagc

SEQ ID NO: 47 - DNA, 23 bp, Artificial Sequence
  Description of Artificial Sequence: Synthetic primer
cgtagcagtccccatctgtaatc

SEQ ID NO: 48 - DNA, 23 bp, Artificial Sequence
  Description of Artificial Sequence: Synthetic primer
atgtcagaggagcaggagagaga

SEQ ID NO: 49 - DNA, 23 bp, Artificial Sequence
  Description of Artificial Sequence: Synthetic primer
cacgcctcacatccaatatgtta

SEQ ID NO: 50 - DNA, 23 bp, Artificial Sequence
  Description of Artificial Sequence: Synthetic primer
ataccctcctgacatctggtgaa

SEQ ID NO: 51 - DNA, 30 bp, Artificial Sequence
  Description of Artificial Sequence: Synthetic primer
gctttcagtgatggtcagtgtgcttatgac

SEQ ID NO: 52 - DNA, 28 bp, Artificial Sequence
  Description of Artificial Sequence: Synthetic primer
tggaagaccaggagatattcagggtgtc

SEQ ID NO: 53 - DNA, 25 bp, Artificial Sequence
  Description of Artificial Sequence: Synthetic primer
ttgcttaactccacacctgctcctg

SEQ ID NO: 54 - DNA, 24 bp, Artificial Sequence
  Description of Artificial Sequence: Synthetic primer
tgcttggaactggatcaggcagtc

SEQ ID NO: 55 - DNA, 19 bp, Artificial Sequence
  Description of Artificial Sequence: Synthetic primer
caccctggtcaccgtctcc

SEQ ID NO: 56 - DNA, 21 bp, Artificial Sequence
  Description of Artificial Sequence: Synthetic primer
agacagtgaccagggtgccac

SEQ ID NO: 57 - DNA, 24 bp, Artificial Sequence
  Description of Artificial Sequence: Synthetic primer
tgaggaacggatcctggttcagtc

SEQ ID NO: 58 - DNA, 21 bp, Artificial Sequence
  Description of Artificial Sequence: Synthetic primer
atctcctcagcccagcacagc

SEQ ID NO: 59 - DNA, 21 bp, Artificial Sequence
  Description of Artificial Sequence: Synthetic primer
cctcccatgattccaacactg

SEQ ID NO: 60 - DNA, 20 bp, Artificial Sequence
  Description of Artificial Sequence: Synthetic primer
ctcaccgtccaccactgctg

SEQ ID NO: 61 - DNA, 100 bp, Artificial Sequence
  Description of Artificial Sequence: Synthetic primer
ctgtgccacaaacatgcaaagataagttccatgtgacaagtctgaactcagtgttggaatcatgggaggcggccgcgttatctatgctgtctcaccatag

SEQ ID NO: 62 - DNA, 20 bp, Artificial Sequence
  Description of Artificial Sequence: Synthetic primer
tgctcaggcgtcaggctcag

SEQ ID NO: 63 - DNA, 20 bp, Artificial Sequence
  Description of Artificial Sequence: Synthetic primer
tgctcaggcgtcaggctcag

SEQ ID NO: 64 - DNA, 22 bp, Artificial Sequence
  Description of Artificial Sequence: Synthetic primer
atggactggacctggaggatcc

SEQ ID NO: 65 - DNA, 20 bp, Artificial Sequence
  Description of Artificial Sequence: Synthetic primer
tccacgctcctgctgctgac

SEQ ID NO: 66 - DNA, 21 bp, Artificial Sequence
  Description of Artificial Sequence: Synthetic primer
atggagtttgggctgagctgg

SEQ ID NO: 67 - DNA, 21 bp, Artificial Sequence
  Description of Artificial Sequence: Synthetic primer
tgaaacacctgtggttcttcc

SEQ ID NO: 68 - DNA, 21 bp, Artificial Sequence
  Description of Artificial Sequence: Synthetic primer
tcatcttcctgcccgtgctgg

SEQ ID NO: 69 - DNA, 20 bp, Artificial Sequence
  Description of Artificial Sequence: Synthetic primer
gactcgactcttgagggacg

SEQ ID NO: 70 - DNA, 20 bp, Artificial Sequence
  Description of Artificial Sequence: Synthetic primer
atgtggccacaggctagctc

SEQ ID NO: 71 - DNA, 18 bp, Artificial Sequence
  Description of Artificial Sequence: Synthetic primer
atgagggtccccgctcag

SEQ ID NO: 72 - DNA, 19 bp, Artificial Sequence
  Description of Artificial Sequence: Synthetic primer
atggaagccccagctcagc

SEQ ID NO: 73 - DNA, 20 bp, Artificial Sequence
  Description of Artificial Sequence: Synthetic primer
cctgggagttacccgattgg

SEQ ID NO: 74 - DNA, 31 bp, Artificial Sequence
  Description of Artificial Sequence: Synthetic primer
ggcgcgccaagcatcatgtcctacctggctg

SEQ ID NO: 75 - DNA, 96 bp, Artificial Sequence
  Description of Artificial Sequence: Synthetic primer
caaagtacgtggcacctccctcgtctttcttcctcctgctccagccaggtaggacatgatgcttggcgcgccgttatctatgctgtctcaccatag

SEQ ID NO: 76 - DNA, 20 bp, Artificial Sequence
  Description of Artificial Sequence: Synthetic primer
cagtgccagcctcgtctcat

SEQ ID NO: 77 - DNA, 20 bp, Artificial Sequence
  Description of Artificial Sequence: Synthetic primer
aggggccatccacagtcttc

SEQ ID NO: 78 - DNA, 24 bp, Artificial Sequence
  Description of Artificial Sequence: Synthetic primer
cttcactgtgtgttcttgggatac

SEQ ID NO: 79 - DNA, 30 bp, Artificial Sequence
  Description of Artificial Sequence: Synthetic primer
gtgtaatgctttggacggtgtgttagtctc

SEQ ID NO: 80 - DNA, 38 bp, Artificial Sequence
  Description of Artificial Sequence: Synthetic primer
gcatagcggcgcgccaagcatcatgtcctacctggctg

SEQ ID NO: 81 - DNA, 22 bp, Artificial Sequence
  Description of Artificial Sequence: Synthetic primer
gacatgagagtcctcgctcagc

SEQ ID NO: 82 - DNA, 18 bp, Artificial Sequence
  Description of Artificial Sequence: Synthetic primer
aagccccagcgcagcttc

SEQ ID NO: 83 - DNA, 21 bp, Artificial Sequence
  Description of Artificial Sequence: Synthetic primer
atggtgttgcagacccaggtc

SEQ ID NO: 84 - DNA, 21 bp, Artificial Sequence
  Description of Artificial Sequence: Synthetic primer
gtcccaggttcacctcctcag

SEQ ID NO: 85 - DNA, 21 bp, Artificial Sequence
  Description of Artificial Sequence: Synthetic primer
tcctcasyctcctcactcagg

SEQ ID NO: 86 - DNA, 20 bp, Artificial Sequence
  Description of Artificial Sequence: Synthetic primer
cgtccttgcttactgcacag

SEQ ID NO: 87 - DNA, 22 bp, Artificial Sequence
  Description of Artificial Sequence: Synthetic primer
agcctccttgctcactttacag

SEQ ID NO: 88 - DNA, 20 bp, Artificial Sequence
  Description of Artificial Sequence: Synthetic primer
cctcctcaytytctgcacag

SEQ ID NO: 89 - DNA, 22 bp, Artificial Sequence
  Description of Artificial Sequence: Synthetic primer
gctcactctcctcactctttgc

SEQ ID NO: 90 - DNA, 20 bp, Artificial Sequence
  Description of Artificial Sequence: Synthetic primer
cctcctctctcactgcacag

SEQ ID NO: 91 - DNA, 20 bp, Artificial Sequence
  Description of Artificial Sequence: Synthetic primer
gccacactcctgctcccact

SEQ ID NO: 92 - DNA, 21 bp, Artificial Sequence
  Description of Artificial Sequence: Synthetic primer
atggcctgggtctccttctac

SEQ ID NO: 93 - DNA, 84 bp, Artificial Sequence
  Description of Artificial Sequence: Synthetic primer
attactactactactactacatggacgtctggggcaaagggaccacggtcaccgtctcctcaggaagaatggcctctccaggtc

SEQ ID NO: 94 - DNA, 28 bp, Artificial Sequence
  Description of Artificial Sequence: Synthetic primer
ctgtcgttgagatgaaccccaatgtgag

SEQ ID NO: 95 - DNA, 89 bp, Artificial Sequence
  Description of Artificial Sequence: Synthetic primer
ggaactgatgtgatctcagtcacacagctaatgcaaaggtcagcaggctgtttactgcctggaggttcatcgcccaattccaaagtcac

SEQ ID NO: 96 - DNA, 25 bp, Artificial Sequence
  Description of Artificial Sequence: Synthetic primer
ctagtctgcatgggtctccgcaaac

SEQ ID NO: 97 - DNA, 92 bp, Artificial Sequence
  Description of Artificial Sequence: Synthetic primer
ctggtataatcataagtctccacttaatagttctgtagacagaatcttcatttagacttacagaccgcggccgcaccgcagggtaataactg

SEQ ID NO: 98 - DNA, 83 bp, Artificial Sequence
  Description of Artificial Sequence: Synthetic primer
gcaacccttcttgccactcatgtcccagctctcaccatgtgacatagcctgttaacaattcggtcgaaaaaagaaaaggagag

SEQ ID NO: 99 - DNA, 83 bp, Artificial Sequence
  Description of Artificial Sequence: Synthetic primer
aatgttcttagtatatataaacaagctactcccaattcatagtcaactaagttaacattccacatgttaaaatagtgaaggag

SEQ ID NO: 100 - DNA, 86 bp, Artificial Sequence
  Description of Artificial Sequence: Synthetic primer
ttaacaggctatgtcacatggtgagagctgggacatgagtggcaagaagggttgccagactccccctttacctctatatcgtgttc

SEQ ID NO: 101 - DNA, 86 bp, Artificial Sequence
  Description of Artificial Sequence: Synthetic primer
cttagttgactatgaattgggagtagcttgtttatatatactaagaacatttgtcagaagctctttcttgtttattcccagtttgc

SEQ ID NO: 102 - DNA, 22 bp, Artificial Sequence
  Description of Artificial Sequence: Synthetic primer
catgtccgtatgttgcatctgc

SEQ ID NO: 103 - DNA, 19 bp, Artificial Sequence
  Description of Artificial Sequence: Synthetic primer
gggaagatgaagacagatg

SEQ ID NO: 104 - DNA, 17 bp, Artificial Sequence
  Description of Artificial Sequence: Synthetic primer
tggagtggattgggagt

SEQ ID NO: 105 - DNA, 28 bp, Artificial Sequence
  Description of Artificial Sequence: Synthetic primer
gcgatcgcaaagacgaaagggcctcgtg

SEQ ID NO: 106 - DNA, 27 bp, Artificial Sequence
  Description of Artificial Sequence: Synthetic primer
acctggtgatcgccaacaaatactacc

SEQ ID NO: 107 - DNA, 75 bp, Artificial Sequence
  Description of Artificial Sequence: Synthetic primer
gcggtgggtctcccacgggggcaaacagcagtggtggacggtgagcgtacggttatctatgctgtctcaccatag

SEQ ID NO: 108 - DNA, 72 bp, Artificial Sequence
  Description of Artificial Sequence: Synthetic primer
ctgtcagctggaagcagttaaggttggcctttgtctgtattcgtacgcacacgcttttcaattcaattcatc

SEQ ID NO: 109 - DNA, 27 bp, Artificial Sequence
  Description of Artificial Sequence: Synthetic primer
tgttccatcctgtacacctggctctgc

SEQ ID NO: 110 - DNA, 29 bp, Artificial Sequence
  Description of Artificial Sequence: Synthetic primer
gcatctgctttatcacatgcagacacagc

SEQ ID NO: 111 - DNA, 191698 bp, Artificial Sequence
  Description of Artificial Sequence: Synthetic polynucleotide
aagcttgtttggtgagagtgaaacgtgactgtggaattgattctttgttgtgcaaaccagaagaaattttgaattttgtcagaatcaaaacggagtcacttttgttaaaacttttgcaaatgggactgggaaaggccatagaagcagggttctcatacacttacacttggtaacaagaactaccacaaatagagcctaaaaaacacaaccttgcacaaaatccaccacaactttaggaaaaagctacccccacaaggatatgtcctcatgtactgtgagtccaactttccactgttgccacccttgttattaatctttgcagcccaggaaaattgtctcaaagcaacttagcaacttacttagcccttcttattttaactttaactgcctaagaatttataccgtgaagtaattgcttcatttagtgttaatattaatgcccttttgacaatctttgaagctctttttttctgatatttcttccaacataaagaatgggagctttttcaccatataaagaatttttaggaagatatgatggaaagggaaactcaatgtattgttcagtgtttctgcctaacacatcaatctcttaaaatattttgctgtgtctgcatgtgataaagcagatgctaacactggagataaaagaaaaaaatgcacagaccttccacattccaaatcataaagtggtactggatgtgtttctgatgaagtgaaccatgggtcataagtgctagtgcaagtagctttggaaaatggagttcatagcttcttaaagttttgctagttttaatttaagaatgttatttactatttctttttagtacaagctttccagaagattcttgatggtaatggaagtgtcgcatttaagaattacaaatgactcacagagttactttgtaattttttctgtagggtgtacatgtcagtcacttgacataaaagctcatatgtcacagatagaaaaatgaaaattgagccaattttaataactgcagtggaaatagtttttggcaatgagtgcttcaagacaaccacaaaataaatcggcaaaatattaaaatacagcaggaatctgatctcagtttctctgccttataagaacaaggctgtcccacatcaaaattattattcaagctctaggaaaaaatacacttttggattctggaagctaaaagctctctccttagatagtgctaaagtacttgtgaaatgcagagttgtgttcatgaaaaagatgactttattgtgattttttttttttttttttgcctgttgacaactcaccaatctgtctcagatgtaaagccctgctctatgggttgaatgtggttgcacatgactggcagagactgattattcataactccaggtgccctgtctttggagcagctacaggagtcaggcccagactagaagagcccacactgaccttctgcatcacttatgctctctctggccactacatcacaaacagtgcttatgactgggcctgaatctgccagcccaggaaagggctggaatggatggggtgcattggtagtgatggtgggggtcctactagcctgtggcaaatggaagcatctcttttttatcagactgaataatattgtagtgttttcttataccacatttacttcatccctttgtgcattaacacttaggttgtttttatatattggctgccataaatagagctgcaattaatataagagcacaggtgtctttacaagttcatgattttatttcctttccctgtatttccagagaagcgtttgctgagtcatattgtatttccatttttgatttatttatgagctgctatactgtttttcataatggtgcaactaaaaaatggtgtagtcatcatgaaaaacagttttagtttttgacataatccaaacacaatgtttgaatctggttatctataggagtttctagtaaaattggtgaatgtaaattaaaaagcagtaagaaaaatctgcaattcagaaatagtgtacccagatggtctttctctccgaaatgaaagagaaataaactatttctcaggtgagataaactaagatattttcttcacacttgaccagtcatacaagaaatattcaagggaatttttgtataaaagccagcatatgaaaaccatcagcttggaaaaaaacacacaaaacctatatttcaatggtagaaacaattaaaaaaggagaaaagaaacaaacattattactacaaaacaacatcaaatcataaaaccaaacagaaagagaataaacaaagatagagatatatacatatatacaaacaatcataaaacaataaagaaaataatttgagtaaatacttataaataataaccttatgtaataaaattcctcaattaaaaatacagtataaaaattgattttattaaagtcccaactctatgctgcttacaagagactcaaatcatctgagaatctacacacagactgaaagtgagtgggtggaaaaaagatatgctacaaaaatagaaaccaacagcacaaatagctctacttatatcagacacaaattttaagtcaaatgctgtaaagggagaccaaaatggacattatataataaaaaatgatcaatgtagcaagaatacgtaacaactgtaaatatacatatatacatatatgttatatatatgtaacaagaacacataattgtatatatatacatatatacacacacacatatatacatatgtacccacacctgagaactcaaatatgtaaagcaaatctattacatagtaagggatagatactaaccttatacaattatagttggagaatttaacacgttatttagcattggatatgttacctagccaaaaattaacagacaaacattggatttaaactgcactatattccaaatggacctgaatttacagaccattgcaccaaacaacttcagaacacatattcttttttttttaaaaattaaatggatgtgtttatttatctttttttattattattatactttaagttttagggtacatgtgcacaatgtgcaggttagttacatatgtatacatgtgccatgctggtgtgctgcacccatcaactcgtcatttagcattaggtatatctcctaaagctatccctcccctctccccccaccccacaacagtccccagagtgtgatgttcccctcctgtgtccatgtgttctcattgttcaattcccacctgtgagtgagaatatgtttggttttttgttcttgcgatagtttactgagaatgatgatttccagtttcatccatgtccctacaaaggacatgaactcatcattttttgtggctgcatagtattccatggtgtatatgtgccacattttcttaatccagtctatcattgttggacatgtgagttggttccaagtctttgctattgtgaatagtgccgcaataaacatacgtgtgcatgtgtctttatagcagcatgatttatagtcctttgggtatatacccagtaatgggatggctgggtcaaatggtatttccagttctagatccctgaggaatggccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggttttgattcgcatttctctggtggccagtgatggtgagcattttttcatgcagaacacatattcttttcttcagcgcatgtgatactcttcagagttgatcatatattaatacagaaaatgtatcaaaaaatttaaataaaattataccgacgttttatctgactaagatagagtcaaagatggaatcaaactaaacatcagtaactggaggaacttctttttttttttttttgagatagactctttctctgtatcccaggctggagtgcagtgacagaatctcggctcactacaacctccaccttccgagttcaaaccattctcctgcctcagcctcctgataagctgaaattacaggcacctgccaccactcctggctaattttggtatgtttagtagagagggggtttcaccatgttggccaggctggtcttgaaatcctgacctaaagtcatccaccagcctcggcctccaaagtgccgggactacaggcatgagccaccacccagcctggagaaaatttcaaaaaaatataaacacaaaaattaaacaaatcactcttacatggccaatgggtgaaagaagacattaagaagaaaataaaaaatgtatgaaacaaacaaagaaacacaacataccaaatcttatggcgtttagtcaaatcactattatgaggcaagtttagagcaataaatgcccacatcaaaaagtagaaatatcttaattaatcaaaataacaatgcatgttagagaacttgaagaacaagaaaaagctaaattcaaaattatttttaaaaacaataaagagcagattagatataaatggaattaagactaaaaataccagaaaatattaaaatagcaatagtctttttaaaaaagataagcaaaattgaaagccattagctgggctaacaaaaaaaatataaagagctaagacatgaataaatgaggtagaaacagaagatgtctcaactgatatcccagaattaaaataaattaggaaatactataataaattatgtgataaatgtgaaaacctagaggaattggatacattcctggccatatactacctaacaagattgaaaaaggaaaaaatagaaagccttaacagaccaataaaaagtaatgagagggactcacttaaaaaatctatatcctattgaacataaataaaaaaacccaaattactagcacagcaaatcaaacagcatttaaatactaatactaatactaatacagcatgacaaagtagaattcaacccagggattcaattatgctttaatatacacaagtgaataaacatgatatatcacgtatatacgacaaggatgaaaaacatatttttactttaatagatgcagaataagtactttataaaactcaaaacctcttcatgaaaaaaactctcaattatgtgtagaaagaacaacacaataagaccacatgacaagttcatagctaacatcatacttaacagaaaaaaagtttaatgcttttcttctgaaaactggaaaagacaaggaagccaactctcagcacttattcaacacagtactgaaggtactagccagagcagttagacaagagaaagaaataaaggggattacaattagaaaaaaggtagccaaattacctctaatttcagatgacataatcatatatatactaaagactcttgtaaatgctcttagagctgatgaatttagtaaagtttcaagatacaatatcaacatagaaatctcagtggggtttctatacacaaacaataaactaggtaaaaaaaatcaagaaatcccattttcaataactacaaaaactattaaacacctaggaatacatttcaccaaggaggtgaaaatccgtaaatgaacaaactatgaaacactgatataattaattgaatgagacaaacacaaaataagaaggacaatctgtattcatgaactggaataatttatattgttagaatgaccataatgcacatgacaatctacatattcaatgtcatctctatgaaaataccaatggcattattcacagaaatattaaaaagcattattaaaatttgtatacaattgaaaataccccaaatgactaatgcagtcttgtggataaaaaacagaggtggaggtattaacaaccagatttcaaaaaaaattataaaactgtaataacaaaaacagcgtagtgctggcataaaaatccatggaaaaaagtagagaaaccaagacattaatccatatatttatagataacttatttgcaacagaggcaccaaaaatatttattgtgaaaagaaaagtatcctcagtaaattgtgtagggaaaaactgaatatccatatgcagatgaatgaacttacattcccacatttaactgtatataaaaatgaaataaaaataagttaaatactcaaatggaagacccaaaactataaagctgctcttaaaaacttagaaataatgcttcatgaaatctgtctggaaaacaattttataaataagacctcaaaagtacagtcaactaaataaaacacaaacgaattaaattttatcaaactaaacagtgtttacacagtaaaataatccaaatattgaatagataacataaaagtggtaaaatgtattttaaactattaattaaacaggctattaatatccagaatataccagaaaaataaatgtctcaaccacaaaaatataaataatcttattttataacagacaattaacccaaataagcagacgtttctcaaagaaacacatacaagatgccagaaaatatttgagaaaaaatggtcaccatcggtaataatcaggaaagcacaaatttaaagtacaatgaaatattatctcaccccagacagaatagccatattcaaatacataaaaatagtgctaatgtggatgaagataaaatgggacatgtatacactgttgatgagaatgtacactcatacagccactatggagagacgtatagaagttagtaaaaccacaaatgcaacaatcatatgatacagaaattttacgactgaacatttgtcccaaggacaggaaattaatatattgaagaggaaaatcaatattttgatgagatttcttcactcccatgtttattgcagccctgttcacagtagccaagtaattgaatcaaccgaagtgttcaatataaggtgagtagagaaagatgatgtggaatatgtacataatggaattctacacagccatgaaagattaaattgtgtcactcatagaaacttgcatgtaacatataagactctatgttaattgaaagagccaggaacagaaagctaaacaccacatgttttcactcccataaaatagtcaagaaatatccataaaacataaataattgaaattggacatgaactatagaaacaataattgtcacctgaatatttattttccttcaaataatatataattcaatgatagtaagaagagtcctgataaataaatcatgttgagataaagagctactgaattgtgcattccacactaaatggaaacaatgccataagatccagtgttgtgtaggatctgtttacctttttacctcaaatactacaagtcactcccttgttctaatcaccccgcaaaactgatattttgttgctttatgttatgtcagtaaaaatgattccacattggaagcttcatgtgttgctcagaaatcaccctgttgataaaatgagcacaactacagttacaacctttctgtagatattttctgcatatgatcctcactttttatttgttgtttttgttcacagtttctttaagcactcagagttatatagcatattttcagcatattttaattattttccattgttatggtcagtgctcctgtgggctcaagagtcaggtgttgtgtgactgccagttgacttcactgccacctttacctacacaaaacactgcaagatgaaccatgatgtgtaagaacccatccacaaagtgcttcaaataaagacaaggtgacttgtgtatagatttagtgagactggggaacagttcacggtgttatgttacagaggagcagaaaggtgaatctctctcggagttattgagggtgtaagagctgcagttttggagggtggtgaaaggcacttttgagtgggaagccctagagcatgtgtgaaagctgaaggaatgatcaccatgcacatggacgctgatgaggcatgtggtaaggtccattccctccagatgttcctggatgggcggttgtaggatggctcatgtatatgaaaatgtgggcagggctgaaataggaacaaggccatcatcccacgggaatgcgagaaagcaaaacagagatggacacccatgaagagagctcattagacctggtgaaggaaagataggaatctcttccaaaggctccgctgttcttggctaaatatgaattgtggtgatagactgaaaataaggaggggaagggagatatgactcaagagaggaaaaaccctaagacagcataaaccaaatctacacagaacaatcacatggtagatgccagggtggggctgaaacaggagcttcaatctactgggtacctagttgagatcctttgacatttcttgtgaggtaattctagtgatgatgaatttcctcagttttcctttgtctgggaagtatttctctatccttcatttcataagagatgttttatcaattttaggttcttggttggctgctttttccccccagaaatttaaatccagttatttgctgcataacaaagtttctgccagtaacagatggtggttccacggtgctatacttccttacttatctatatctctttatgtttagatacacaaataattactactatgtttccatggccaacagtattcactacggttgtttctgagtcactggggtgttgctttttctggccagaaccctctgtggccagtggcacttttgcctgagttcttgtcctacatgtggaaagaatgaagtatgcagccatgtggagggtaagcaagacaaagcctagcttcattaagcattagagcatctcagaggagacccccagtgagtagctcctctctgtaggcaggtagactggttgagtgttcagctctaagcagagagggtagctcctccctgcagccggtcgtcctgtggtcttcccagttctcaggagagagggtagctcctccctgcagctggtcgtcctgtggtcttcccatttctcaggagagagggtagctcctccctgcagctggtcgtcctgtcgtctctccatcctctgtcctgctccagctgaggccaggggtttttacggacctccgaggggaggaagtgcaagcccattggtccatgggtgctcatgggtgggccgtaggaagcaccacaagtcccgactctggtctgaggatctgggagccccggcccagccttcaggcccttcctggggacccgcccctgtgcacaggatcttcctgcctcctgttgtagttcatggtccctggggctccgccctgactttgctccaagatcagagcaggcaccagcagcaggaagaagccaggaagtgggagcaggcacttcggagcatgcaagagcacagggcttttcctggggaccccaagagtgcaggggcgcctgaggccgcagcccccggtttgcggagcagggcttctgccggcttcatggagcgagaggcccgtgtcttcagccgcagtttgggaggctgcagccacagccggggaggcagggctccttcctgttcctcgacctccaagagcacagagtccgagcccactgccctggtttgcgcagctggagccgcacctgagagatgagagctgctgcctgctcctggctcccaccggctccgtggagcatcagcccctccacccctccttgcagcctgggcaggggctcctgatcctctctgggccctggccggcgtccagggcaggagtgacatctccacaagctccctgcattgccccggtgctcagggaggcccgggcagagctgatgacgaccccggcccgtagtcgggagtggcggcctccatggtcaccctgacatgcggctgaaccctggggacgcggcccaagcagcctgcacagaacctcccaaggcccaggaaccccgcaccctaggcggggtgggcacagcggctgctccgctgcccgggttttcaaggaggcgccacttccacttccctccctggaaccccgaagtttgacatgggggctcctttctgccttgctccgcagctccccttcccccggagtggagccccctgtttccctggcgttccctcccacagctgcagtgttctccatcggtgtcatcaccttccagctctgctgccctgctctgcagactaaggctctgattccataagagaggggagctgcttcccagtagaaccttgctggggagctctgttcccatctcagttcctgaggggttaaaccagtgcatttaggatactggttttggtggtttgcccctgttgagtaatttcttagttctctagtgggtgtaagagacttggctctggaagcatttcagaagtgtgggctctgatacaccccagacagacactttgggaagggaagatttttgtgactattctcattataagggaaaggcattcaaaagaatagaaaaactctccagtatgtggttcctgagaatttctcactaaaaacatgcttatcacactcgactcaaaacagttcaatgtatattagtgtattttatcttgtactagcctttattgcatttggtgaactctgccccagttcagctcatactctagctttgattctccctacaaaaacttgtctctctctagatttcagatttgttgattgtcttaaaatttcaatgatctgaagtattaaagaaaatttgcaaaagtccattttctctgattaacagttattgttgattttattcttgttgtaaaaaaaagaaattctcatctatgtacatttcaaacctgaataacaaaatttttattaacaccaaaaataataaaagaatccaaatatttatcagctgcctaatagaaaaacaaatcatggtaacattgttcgctggaatattacccatcattcataataagggaatgtctgatacacaaaataagaagataaaattatcaagtatttaaattgagtaaaataagccaaacaaataagagtatgtatgattctatttttaaaaattctggaaaatgaaaactgatctaaagtaatataaagaagattagtagtttcctgggaatatgttggcagaagggaaggagaaaggataaggaaatagaaataggaagtagaaggacagaaaagaagttgagggaatttcacttgtccaccttccttataatggtaatagttatgccatgattatcagttttacactttaaatatgtaaagtttataatctgtcaatcaaatcttataaaatgtattatgaggaaacaagttgaaaattagacaatgtaggagtgacagaaagatagatatgagtatgttgaatgtcagagatacctgaaagtttatctacctgaaccctagttctctccatagtttaaggtaaacaggagagtgcaggaaaatcatccatattctgattaggcagtggcttctgcaaaccacactaggcctggccggctgtgtcctggagttggctaagggaggagtcagggccagtggtgagaagtgcaggcccagataccagaactcactcatcccagacatgagctcttagatacacagagagcccatccatgtgtggatttatcttacatctgtaagtagagaacattgactcttacagaacataatttacacacataggtaaatctgaaataaggtgatcagtgtgaagattttatcacagcacagtttcataataagcacaatttctcaaatcccattgttgtcacccatcttcctcaggacactttcatctgccctgggtcctgctctttcttcaggtgtctcaccccagagcttgatatatagtaggagacatgcaaatagggccctcactctgctgaagaaaaccagccctgcagctctgggagaggagccccagccctgggattcccagctgtttctgcttgctgatcaggactgcacacagagaactcaccatggagtttgggctgagctgggttttccttgttgctattttaaaaggtgattcatggagaactggagatatggagtgtgaatggacatgagtgagataagcagtggatgtgtgtggcagtttctgaccagggtgtctctgtgtttgcaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagacacagtgaggggaagtcaatgtgagcccagacacaaacctcgctgcaggggcatctgagaccacgagggggtgtcctgggccctgtgaactgggctgctctccgtggcagcggctggtggtgctaaaggctgattttctctcagcatctggggctgattcatcaagtttcctcagagacctttcagattacaattctgtacttacgtttaatgtctctgaatgtgacactttccttccctggtgtgtctttgtttttgtgacaagaggacacattctcacctccacagaagcccgagtgtcactttggggacagaaatgaccctgccctggtcaccagaatcagagtcccgaggaagcccaggaggacctgggaagtgtttttcaatcagactcagggcaggcgtctccgtgggaatctctgattggaacaggctttgggattcagattgggaccaagagggaggctcacccagggccagggtccttagaatcctgacagttttcacagtaaccccatcgtcctttaaaactgaacatctaactcagaactgacccatttggtcctttctctgtaatccattttccttttctctaggcttcattcttacacttcccttttcaccttcattctgaaaatggagggtgtgcttcctgtggtctaaaccacaggcctcagatgcattacctggaactcaggtgtggctctggctatggctcctgtggacctggcaggctgagggatctttctcattccctggtgcctgcatgcccctgctgtcttctatgcgtggatgcatttgggaaatgcaagtggacactcatagtcgtttcctcaaatgggatactgttgtagagctgatcttgtgcttctcaccctgtcacagagcccccactctcacttgtggatttttgggagagctgaggatggacactttattgggctgtgagctctgcatgatggcaatcgtgaggtctgggtgggcacagccagagccaatggagctggccaaaaggaaagacaggacggaattcctgggaagtcctacagctgctgtctaccatagagttccattgtcttctcctctgctaggattaaaccagaccgaccaagttcatctaggacaatcttcctgacctagagaagtgatgacaggctttaataacacctgtattatacatcagagcaacacctagattagtgtttgattgaataattgagactatgtcctagtcaaggtgacacacaaaatcaattattaccatgattaatattttatattgattaatattttaatactaatattaatcaatgcaatattgatttaatattaattaatattttatatttgacaatagaatcagactcatgttataaataattttgcaaatatatgtatattattattggtcttctgagcataaatctccattagccgattaagtgtgcatgcattggtcgaaggagggcatccacccttttgagggaaaatgcatggagggtaaatgaggctgggaagctgatggcatatgatggaagcctgtccctgagtgaaggagagagggaggcaggattgggtggaactttcctacatttctgtgctgtgcaaagaaactccagattatcactgagtctcctgcaagtcaaagttgcccctcaggaaacccccatcactcccagcaatgactctgccccagatgagtgcaaggctcactctattcctgagaaaggagcacaggatatgggatttagcatgagccacgtcatggacgtcagagagcaggagctgggtgcatgatccaagtgcactgttctgcctgtaggtggagagaggaaggtgcattcccagagctaacacactgtggatttttatacagaatacacgttttcacctgatttattggaaggcatatgaaaaaatgtgcagtccacaaacaattgtaatttccaaatttaccacaattgcattatttcttcattctgcatgatgtcctggaacagagttacatttttcatgggtattgtttcatggattgaggacatgaatttcacacctgcctttttagccatgtgcagagaccttgagtagagcatgtctggacctcatctacactatctctcatgccccaagggaaagagtggagacttgactgactgcaaactttggggtgggagctgctcctgcacacctcagaggctgcagagaccccaagtgcagttttattgagttggggtgtctttctatgtgggggaattatgggctgccccactcctggtgattgctggtcagctctaaagacgggttcagaatgaggtcacctggtaacctttctcactgcagctccattatgtaaattaccactaccagattccaggtaataatgcaagctctatttttgcgacctcattttcttatcttttttgttcataagtttggttatagaaaatgttaccacctagtttcctgattcaaatcctataatttgctgaactactcaggatgttttttaatgtgcccagtatttgggaaatataaatgaacagccatgtgtggttcactgagtggacatagtcagttaagtacattagtaaaaacatgattgctgaattgtatagtgaaactacaattagatttgcagaaaattgcctccagtaatgtctgaagggagagccacccagccaatcccgtctctgggcttggaggaagctcactacacaggccaggtcacatgggtgatatccaaggtgcagctcccagcgttactgtgctattttccaggaaccagacatacaacttggcatctcagaagaagatctccaagatttcctttacctggacttcatgggcagcacaggaccagcaggagatgctcagaactcacccaaggcagaaccccagggaagagcaggtgcggagaggaaccagccagggaacctctgaccaccatctagggttgccttcttttccttcacagcatggagccctcaggagaccacccactaggttgtctgtaactcacgtccttcttgtcttgaagcaaaacagacataaatatgaatttgcagttagccccttgaacctgggtcaattttttctgagaatgccaacttaatcgtcaacatcatgggcattatatcaaaatcgagatggatatttagtcaccaggaagacagtttgtctcatggtagaagtgcttattcaattaaaaattacattttaatgaaaaggtctctaagtgaggactgttcaaataataaagtattagtgaagtatcagaaaaataaatggcaccattatctttggtatccagttaatctataaagcatatcaatattcatgttgtaagtggcctaggacaagttatggcagtatttaggctataaggagacattgctttccttcttagataggaatgtccttttttatcatactttaagttctggggtacatgtgcagaatgtgcatgtttgttacataggtatacaagtgccatggtggtttgctgcactcatcaacccgtcatcgacattaggtattactcctaatgctatccctcccctagccccccaccccccaacaggccccagtgtgtgatgttcccctccctgtgtccatgtgttctcattcttcaactcccacttatgagtgagaacatgcagtgtttggttttctgttcctgtgttagtttgctgagaatgatggtttccagcttcatcaatgtccctgcaaaggacatgaacaggaaattccttctaaatgaactgtgttttgacaaatattatccagtgactcttcctacatggggtttctacatgatctatttttcttttccaaaaacaaatcactcaagtttctcatctcctgagtgagaaaaattttccccaaacacaatctcagtctaggtagacaccttcatgaatgagccttcattctcagacaggcacacactgtccccatgtggatgcttctctcagacaggcacacatatccccacatggttgggatcatctgctgggactttgccccatggggatctctattatcactggggcaagttagcacctcgatcctcatccacactgtggcctttgatgtctgtgacctgccacaccctgtctgtccctcagtgtctagaatggtgaagtagtccaccccagggatggaggaagatcccagattttcctgtgaaggagacagaatgccaatcacagagatggaaatctctcacatccctcctgggtcatattctgggcagggtctctgaagtcacccctggatcagtgtcctaagatgtctccctctatttccttgggaagaacccatagaaagacaaataagtttttctattagggcatcgtagaacttgtgctttcttgtgtgacaaatataggtattttgactattttaaaaattagatataatattaagtctaccaaatatgtaaatatataagctttataatgtatccctagagggatgtctcctggaattgagaattgaatatatatatatatatatatatatatatattccaagataaatcttggtgaacattataaaattgactctaatatttatgttcaagatgatcatttcaaaaaagttttaacaacagagaccagatgtatctttccaccagaaataactgtaaaacacagtgaaattttttaaacatgattttaaggtattttacatcaaataacaaggacagtgattgctgaggtggggaaaatatacaaaaggagccctctgatgaacgcatgctttgctactttttaaagagagtttccaggccacagtgctgaagaggaaccaggtagatttgaagttgaggaaaaggagctgagatcccagacaggccaagaagtgtggagatcacagactagacagtggatagcagaacactgttcagagagtgagccccgtagatggccggagagagacccagccttggtagagtgtggatcagtgtatgggaaccctggaaagttgtacatgagaacacaccttactctagggggcttgccttaaaatctaaaattaccctaaaatttaaacataatcagttacaaattttaaaacataaagaaagacaccatgttaaagaaagataaaggaaaggtggatttgcaatattaaaatataaaaagtgtatttctgaacaaatgataatactgatgaggggggacaagtttattccatcacggcaaatgatttaagagaagaacattccaaatgcttatggccctaatgaggaagcttcaatcacgaatataaatagagttatctcattaccagtgtgatggtgtgagaaacttcaagatttccaaagagacaacctaatctggtaaaaattatagaaacccaacctgtactatcaaggaaaattattctgagaacacacagtaaatgaaatccattgactgacataaagtcctcctgttgactgaagggttatgaccccccacaaggcatatgttggaatctcaactccatcgtgacggtggcaggaggtggggcctttggtctcctttgaaaggtgttgaggctccgtttcatgaatggaatcagcgtcctgatacaataccccagagagctccctctttccttccaccaggtgtggtcacagtaggaaggtggcaatctataaataaagaattgggacatcaccagataccaatctttaagtcatctttatcttgaacttcccagccttgaaaattgggacaaatgcatttatgttatttctgagccacccagtccatgatatcctcttatagcaactcaaacagtcttagcaagtgcagtgaggatcacaatacttgagagaagagcattacctcttctttacatctcaggatcacagaatcttgaccttgggctgaactgacaagaaggtggtgcttccctctcccccagatctcagttgaggtcatgatgtcagatctttatggtggagactaaattcctgcctgtgatttgatggatgcctttctcctcccagcctcactcacaagacatagtttccatgtcaggtgttatagaccaagaacaggtggaccccgattattctcaccccagctcacttgtagggcagaggttctgggagcttcctgggagaggaacagtgagatcatacaagtccatcacttccatgcagttttctgtacttaaagcaggagtgtccttctgagctgcttgaaccctttcttctgcaccaaggtagagacttccatgtttttctagtgatacagtcagggcataaaaacagtgatagaaagctctctctaaagggcgtgaccagatttgcagtagaatgagaatagtttcaaccctaaagttcatctaaaatgttagtggttttcatggtaagtaattaatagaaacctgacagctccatgacagcaatatagaaatcaatagtccactcattttaacagagagaattagaaaacctataatttaagaataaccagctgggcactgtggctctgcctgcagttgaatttacttgggagtttgaggtgagaggatcacttgagcccaggatttcaagcgcagcctggaaacatagctagacttaatttcttgaaaaaaatcagtgctattttggggtcagaacaatcctcaaaaatggtccccggaaagaagcccaaatttaattgcaccagattgttgaacgatttatgctacaaaacagtgtcacatgtcagaaatgagcacagtgtaacatctacatggtttgttaagagacacaaatggtcaagtagaacaatcaggtaattaggctgtcgaaggcaacactgccaaatgacagcatttccgtggaaactgcgtgtacatccaggactgcacctgtgaacgatgacatcatacccttcacagtgtcgaggaaagagacatcactcaaacagacaagccaagggacttcagaaaatataaggggaaatacagtgtgcaaatatgtaaaaaatgcaataagatgattactcctaaatgaatatcaagacacaatcacataatatgaaattaaattttcctgaatgataggattactaccaatcaccccccaggacaccctcatctactctgtgcacagccttctcgtcaggcgtcccagcccagaccttgctatgtagcagaagacatgcaaataagacccccctttttgctgatgaaaagcagcccagccctgaccctgcagctctgggagaggagctccagccttgggattcccagctgtctccactcggtgatcggcactgaatacaggagactcaccatggagtttgggctgagctgggttttccttgttgctattttaaaaggtgattcatggggaactagagatactgagtgtgagtggacatgagtgagagaaacagtggacgtgtgtggcactttctgaccagggtgtctctgtgtttgcaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacacacagtgaggggaggtcagtgtgagcccggacacaaacctccctgcaggggcgcgcggggctaccagggggcgctcgggactcactgagggcgggacaggtcccaggaacaggtgcagcggtaggttttctttctcctcagctggagaagtcaggtttgtgttttcagaactctggagtcttacaggttgctacattttcatacagttattagtatgtatttattatcattggtatttaagttttaataattttaaaccttttatgtagtgttattttttaaaactgtttactttcatttgcagttattcttccagagtttcattaacatctattgctatgagcaactacatagctatgagagcataaatttacacctgtagacgtaggtctaaatgccacaaacctgtgcataaatgtatagtgacttatatttaacattataataagataatttttaaaatatatcctaaacgatcaaacttactgatgaactaaatataaattatcagagtaatgcataattgatttcaataattttatattgtttatattaattaatatctatttctttactgaaacataatatattggtcatttcaaaatagctacgatacatttcaaatggccttgatgctaataatgaaaagattttgaggtgattaatatgctaattagttatatttaattattccatattgtattaatatatcaaaacattgctttgtacctcataaatagatacagtcgtaatttgtcaattttcaagacagttatttaatccatcctgggtcataatctttttttcccctgtccatggctgattggattgtcctgataaacccatccatacgcctgcctcccgcaggcttctgagacgggctccatgaaggccagaagcaggcaccctgtgagagtccacacgacctggagcctccctctccttggattaggccatctcctcgggatcgcagggctcttcattatcctcacccccttgttgtaccaaacaagcaacatcacactttaattcatcacgctttgctttaattttccccccaaaaatcaaggtaataattttagcaataaacatcacaacctactatgagtaagtcctttccaacgtactaaggtttcttctgaggactttacatgtattacacagtttaaatttctttatgaaatgagataccaatatctctatattagagattgtttttctaagtcgtttctgacaattaatttgtccaagggcctgtaaggattctgttagaaatccaggataaaatttgaaatttcagcagtaatatctggaaaaacattgagactatatttaacttcgtacacgtgctctcaaatatccttatttccctaaaggttgttctcagttattattttacacatgatatctataattaatactaataacacaggttaaaatattatctcaattatttaacgacttttgataataacaaaatacatattccacatatttttgaccagtttgttttctctatgaaacacgtgtttattaacttattattatcagatgtcacccttatctttctgatttctgggatttaattctagcaggtatcgtttagtatattttattaattcatattatattgttcacattttcagtatgattttattatttgcattgtttattgaatttgaaactttcttacataatttttttaattttttattttcatgagatgtaatttcaatataagtaataatgcatagatctgcaatgtaccattacaggatttctggcaaatgtaaacacacttgtccccaacagccaaggttggatgtagaggaggcccattcccccagcacaagcgaccttctctgtgcttccagtcagctcccacatttaacacaatgttttgatttctgccactgtagattcactgttcatgttttgattttcatataaatggattcaaacattatagaccccttttctggtaaggggctacttttgttatttttgacgtttatttatgctatttcatatgtaaaattgcatctgtatattgtcatttattcacttaacagactgcctctgatataaaatctcaaagttttgatatatatggataaagagagagggagagagagagagggagaaattttatacttgagtcagtgcatttaacaataaacgacagtaagctgatccatttccctgtcaatgcacttttaatttgtttctggtttattaacatcataagcaaagctgctgcacatattttttgtttttctatttaccttttctcatttttattgagaaagtatgtggaaatatccatttcttcatcataaaagtaaacttcatttgttcagctttatggaactataattgacaataaaattgtatatatttgaggtgcaccacttgatattttggtataaattgtgaaattttcactatgaccaaggagttagcatgtctgttaccctacatttgccattttcttcctttaatttatatgtgtgtgtccaatgagagcacctgagatctatccctttaccagagatcaagtttgcaatacagtgttgatagctatagtcccattgctttacattagacctccagaacccattcaacctgcacaactgaaactttatgcccttgacaagaatcattctatttccactcctcccagccctgggaaccacttttctactctctgcttctaagaatttgaatattttagattccccatataaatgagataatgcagcatttgtctttctgtgtctggcttattccacttagcataatgttctccaggcccatccatgttgttggaaatgttataatttccttatttttagaggtcacataatattccattgtatgtgtatacatttgctttatacacccatttacctacggtcactaactttaaaaaaattctaggccattatgaataatcttgtaataaacatattttttacttactgattttatttcctttgaatacgcagccagaagtgggatcaccagatcacgtaatagttttactttcaatttataaaataacttttactaccactccactgaataattctcttttcaccagctaactgtcagcattttgttatcttttgtgtctgtgataatagtcatggtaatgaacgtgaggtgatatctcattgtggttttgatttggattcccctgatgattagcaatgtggaacacctttccatgtcctgctggccatgcatatgtcttcccttgaatacaatgtctatgtacagttttgccctcttaaaaatcaggggttttttttgctattgtatgggttctttacacatttagatagatccctttgtcagatatatagcttcaagtaatttatttgtctatgattttggtgtcgaatccaaataaatcattttccagatcaactctggaaagcttcttttttccctgttttcttctatgagtttacaattttagatatcatattatatccaagccttgagtacatttttaggtgatttttgtatatgagatgagatgaggtctcatttttttctgcatatggatgctcagtttttacaccatttgttaaaaaggcaatcttttccttattgtgtgtccttggaacaaaaaatctgggagatacacaaaagaggaaaatcttagaccaatattcctgatgatagacctaaaaatcttcaagaaaatactaggaaattgaatatagcagcacattaaaaagttattacattatgatccagtagattttactcctttcatgcaaggctagttcaacatacacaaatcaataaaggtgctccaccacataagcagaatcaaaagcaaaaactatataattatctcaatagatccagagaaactttcaataagattcaacattcttcatgataaaaaccttcaacagactagacatcaaagaaacttagcttaaaatgataagagccatgtatgacaaacccacaactgacaccatactgaatcaacaaaagctcaaatcattccccttcataactggaacaaaacaagaatacccactctcaccactcctattcaacatagtagtggatgttctagccagagaaatcaaacaagagaaagaaataaaaggcatccccacaagtaaataagaattcaaactatctatttttgctgttgataggatcctatgcatagaaaattctatagactctgccaaaagaatcctagaattgataaacaactttagtaatgtttcaggatacagaataaatatacgaaaatcagtagcttttttatacaccaacgacatccaggcatagagaaaaataaatgacacgatcccacttacaacatctacaaaaaaagaaatacctaggaatacagctaaccaaggaggtgaaagatctctacaagaagaactacaacctctccagcacatgttgtttcctgactttttaatgatcgccattctagctggtgtgagatggtatctcattgtggttttgatttgcatttctctgatggcgagtgatgatgagcagtttttcatgtgtctgttgactgcataaatgtcttctttcgagaagtgtctgttcatatccttcacccactttttgatggggttgtttgtttttttcttgtaaatttgtttgagttcattgtagattctggacattagccctttgtcagatgagtagattgcaaacattttctcccattcgttaggttgcttgttcactctgttggtagtttcttttgctgtgcagaagctctttagtttaattagatcccatttgtcaattttggcttgtgttgccattgcttttggtgttttagacatgaagtccttgcccatgcttatgtcctgaatggtattgcctagattttcttctagggtttctatggttttaggtctaacatttaagtttttaatccatcttgaattaatttttctataaggtgtaaggaagagatccagtttcagctttctacatatggctagccagttttcccagcaccatttattaaatagggaatcctttccccatttcttgtttttgtcaggtttgtcaaagatcagatagttgtagatatgtggcattatttctgagggctctgttctgttccattggtctatatctctggtttggtaccagtaccatgctgttttggttactgtagccttggaaacaacaggtaacaacaggtgctggagaggatgtggagaaataggaacacttttacactgttggtgggactgtaaactagttcaaacattgtggaagtcagtatggcaatttctcagggatctagaactagaaataccatttgacccagccattccattactgggtatataccaaaaggattataaaccatgctgctataaaaacacatgcacacgtatgtttattgtggcactattcacaatagcaaagacttggaaccaactcagatgtccaacaatgatagactggattaagaaaatgtggcacatatacaccatggaatactatgcagccataaaagatgatgagttcacgtcctttgtagggacatggatgaagctggaaaccatcattctcagcaaactatcgcaaggacaaaaaaccaaacaccgcatattctcactcataggtgagaattgaacaatgagaacacatggacacaggaaggggaacatcacacaccggggcctgttgtggggtggggggaggagggagggatagcattaggagatacacgtaatgctaaatgatgagttaatgggtgcagcagaccaacatggcacatgtatacatatgtaacacacctgcacattgtgcacatgtaccctaaaacttaaagtataattaaaaaaaacaattacaacgaaaatccttaatgtctcttgagtaggtagagaacatatattttatctaagtaacttgctctaaactgcaaaccaaaataagatgattcaataaagtattttgtaaactagtctttagcaaaaaaaaaaaaagaactacaaaacactgcagaaagaaatcagaaagtaaacaaataaattgaaaaaaaaattccatgctcatggaatgggagaaataatattgcaaaaatggcaatattatccttcaatatttatcgattcaatgttattatcaaaataccagttttattcttctagaaatataagaaaagtattctaaaatttgtatgtaaccaaaaaagaacaaaaacagccaaagtaatcctcagccaaaagaacaatgccagggacatcacactatttgacttcaaactctactataaagccacagtaacaaaaactgtttggtacttgtacaagaataaacacatagacaaatgaaatagaatagaaaactcagaaataaagctgcacacccacaaccatctgttttttgacaaccctgaaaaaaataaacaagcaatggggaaaagacaacctagtcaataaatggtgctgggataacttgctagccatatgcagaagatgggaacttgactcgtgactatcaccatatgaaaaagaaaattaactcaaaatggattatagctttaactaagacttcaaactacaaaaagctaggaagacaacctaggaatactcttctctgcattggccttggcaaagaattactggctctgagaccaggcattttttgtaacagtgatttattttctggggtacatatcatggagtgggattgctgattgaacgatagatctattttagttgcttgataagcctttacaatttttttcacataggttgcactaatttacattaccaacaacagtgtataaatgcattttctctgaattctcatccatatctataattttttgacttcataataataggcactttgactgatgtaaagttgtgtctcactgttgttttaatattaatttatctaatgattaatgttgttcagctttttatttccatatgctttttggccatttgaatatcttcttcacaaaatgtctgttgatgtcttttgcccacattttaatggtgtaatttatttatttgttgttgttgctgagttgtctgtgttcttgttagattctagatgttagttatttattgcacagtaatgtaataaatctaaaagtcaggaaacaacaggtgctggagaggatgtggagaaataggaacacttttacactgttggtgggactgtaaactagttcaaccattgtggaagtcagtgtggcgattcctcagggatctagaactagaaatatcatttgacccagcaatcccattactgagtatataccatcccatgactgggtatatacccaaaggattataaatcatgctgctataaagacacatgcacacgtatgtttattgtagcactattcacaatagcaaagacttggaaccaacccaagtgtccaacaatgaatagactggattaagaaaatgtggcacatataccccatggaatactatgcagccataaaagatgatgagttcacgtcctttgtagggacatggatgaagctggaaaccatcactctcagcaaactatcgcaaggacaaaaaaccaaacaccgcatgttctcactcataggtgggaattgaacaatgagagcacatggacacaggaaggggaacatcacacactggggcctgttgtggggttggaggggcggtggggagggatagcattaggagaaatacctaatgttaaatgatgagttaatgggtgcagcacaccaacatggcacacatatacatatgcaacaaacctgcacattgtgcacacataccctaaaacttaaagtgtaataaaaaaaataaaattaaaaaaatcaattgcaaaaaaactgttgaaactatgaaaatatgaggtaattaaacaacacaattttgaccaatcattggctcaccaataaaattaagatattaatttttaaaaatacaaagaaaaatgaagccacaacataccaaaccctctgagatacaggaagagcagtactaagagcttatagttctaaatgtctatgaaaaaatagaaagattataaactagcaatctattgatttacttcaaggaactagatattttagaacaaaccaaccccagagctagaagaagaaaataaataaagatcatggcagatttcaaaaatattgaaacaaaaaagcaaaatataaggaatcaacaaaacaaaatgtggttattttaaaacatgaacacaattgatagagcactaactaggtcaacaaaaaaaaaaaacagaagattcaagttagcacaagcagaaatgataaaggtggtattataactgacccaatggaaatacaaaagattatcaagacatactgaatatgtctatgctcacaaactagaaaatctagaggaaatcaataaatttctggaaatattcaactaccccccaaaattgaaccaggaaggaaaagaaatcctaaatagaccaatgcgagtaataagactgaatcagaaactgaaaatctcccaaccccaaaagcccagaaccagataaattcaaggtctaattttaccagatgtaccattcttactggaactattccaaaggattaaagagaagagattctttcccacctttgtctaaaatactcgtatcacctaataccaaaatcaggcaaggatacaactacaacaacaaaaagctacagggaaatatccctaatgaacatagatacaaaatagtaaacagaatactagctagctgaaaccaacagcacaataaaagataatacatcatgaccaattgggttttattccagggatgcaaagcttgtctaaaataaacacatcaataaatatgattcaacatataacataattaaaaacagaaaacataagaccatctcaatgaatgcaaaaaagtcattcaataaaattcaatatcccttcatgaaaaattcctcaacaagcttagcatcaaagaaacctacctcaaaactataaaagccacatacaacaaccaacaaaaaactcttaaataaatcaatagaacagggatcttcttaaatttagtaaaaacctatgcaactgatttattcaatatgctggacttggtagtgaagaaatgaatgactttaactaaaaaaaaaagccacatataacaaaacaacattatatggaatgagaaaaagttgcaaaaatattcctgaagaacgtgagcaagaatgcacactttcaccactcctactggacgtattactgaaagtcctagccagaataatcagaaaggaaaaaagaaatgtatgtttcaagttccaagctaaggaatccaggagtggcagacccagagacttgttttttaatctatgaataacatccaaacccctgaccgatcccttggaacacaggatttaggggtgattgaggctctttcttttgggttaaatgaaagttgctaggtggagggtgttaagtaaaaattactacataagctgcatagttttgtcaaatggttgtagttttcttgtccagcctgctgttcctgaaccaccctatatgaaagccctcaataaactatatgtcttgttcactggtttggcctgttgtacacgatgccagtcctattggagtccatattggtctggcgtgacatccagtcaacctggtaaaaggtccaaaaaaaatctcatgagcacccagacaatggaatctaaaaagaggagacccctgcagaaaccttgggcaggctgttaatttctacgtggggcccaacagccgttatccatgatggatggggcccagtgcctgagtatggggataccgccacaatgccaaaagttctggaagaacctcttcagtgggtgcatcttacaaagtgaaagtcagatgtccaggctgttgcattatcaggtgagtggttcttcctgactgcactctgagaagccactgagacagtgctcactgtgtatgctacagtgtgtcagtcacaagaagagctactcctagaaaaacatgccagactagctcagactaatcagagacctttctgtcctgcctgtggaagcagaatggcaaattggggaccgccgcttgtggagcagcacatttgaaggatttctggccatcacatgaattagttacggctgtgatgactaaactgtcatgggaccctaagacctagttcccataaagagttctagggggaggaggatgaagtttggggtaagcccatgggggttcctgtcctctctacacatctggtggctaccaccaaggtaaaaatgggccaactgcaccagcagaggcgagccccagagacatttcccacctgaaataaggaaacacaccacaatgtgggattccaccactgcggaattgctgacacttagaaatgggttcagacagaagaagagagagttgatcacagggtggcttcttcatctgtgaggcatgcgggaggagggcattatactccctgaactcaagattagtaaagtgacatccatcacaaaccatctgggcctgaggcagcacctcgatggtgtcagtcatggagattggaccatccctctccttagctgggtggttgcagactgcaagggaccctggtgaaacgagggagatgtccgctttattagtgtgttctcgtattgctagaaagaaatacctgaaactgagtaattcacatagaaaataggtttaatttactcatgattctgctggctgtatgggaagcatgatgaaaaatctgttcagcttctggagaggcctcaggaaatttacaatgatagtgaaaggcaaaaggggagcagccactttatatggtgggagcaggagcaaagaaagagtgagggtggaggtcccacacactgttaaacaaccaaatctcatgagaactcatttactatcatagcaaggggaccgtgctaaccattattcataaatccggacccacgatacaaccaccgggccccgcctcaaacattagggaagcaaaatcacatacagttgttatgacaggtgggacatcctgaaaacctctctaggcatgtcccacacggccctggagctgtctcaggggagcagtctcctccagtgtttagacgcacaggcacggataatagggctaagtctggccagatgtgtgatattcaacacattgcacaactgctctgttctgtatgtaatttatcttctctacaaatgtaacattgatggttgcattaaatatattctgcaaatatgtaaaaataaaataagatgatgattgctaaatgattatcaaggcacaatcacataatccgaagttacaatttcctgagagataggattactgcccatgcttaccaggacactcacatctgctctgggcactgccttctcctcaggcgtcccaccccagagcttgctatatagtaggagacatgcaaatagggtcctccctctgctgatgaaaaccagcccagccctgaccctgcagctctgagagcggagccccagccccagaattcccaggtgttttcatttggtgatcagcactgaacacagaggactcaccatggagtttgggctgagctgggttttccttgttgttattttacaaggtgatttatggagaactagagatgttaagtgtgagtggacgtgagtgagagaaacagtggatttgtgtgacagtttctgaccagggtgtctctgtgtttgcaggtgtccagtgtgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagacacagcgaggggaggtcagtgtgagcccggacacaaacctccctgcaggggcgcgtggggccaacagggggcggtcgggaaccactgaggacgggacaggtcccaggagcaggtgcagggggcggtttcctgtcagctgcaggaggcgggtttgtttttgcaggactctggagccttatgaggttgcactattttattatggttatttatcatgtgttttttattgatatttgtgttttagtaatttttacatttatatgtaggggtattttttaaaaatacataacttcaagaaataattcttcctagtaatttacacctattcctctaaagttttattaacacctgttgatatcagcaactacatagctatgcaacattaatttacatctataaacatatgtgtgaatacatgaaactatgcatacatgtgtagtcatttatatttaacattataataaaataataaattaaataaaataattgaattaaattaaaagaattaaacttaatgatgaactaaatataaattagagtaatccataattgatttcaatccttctctatggtttacataaatcgatgtctacttgtaagcttaagtatagtgaattggtcattttaaaatagccaagaacaaatttcaaatgttcttgtcaccaaaaaatgataaggatttgaagatttgaggtgatatatatgtcaattagctcgattcaattattccacattgcattcataaatcataacatagctttgtaccccatcagtatatggggtacaaccaaaatttctcaatttccaatgaaattttaattatatattttttaatttgatgcctctctttggatcaggccacctcctcaggattacagtgctgttcagttttctcaacatgctgttgtaccagataagcacaaaacatttaatttcattatgctttgctttagtttttcaaaacaacataaaggtaataattttcccaacaaacatattacagcctattctatacttttttattttttgtttttatgagataaaatttacatgtaagaaaaaatttatagatctgaaatgtgtcactagagagtttctggcaaatgtgaatacccttgtcccgaacacctaaggtagactaaagagcaagtccatacccacaacatgcgtctttctctgtgcctgcggtcaacccctacatggggaagtgttttgatttctgacaccatagatccatttttttctgttttgagctttatataaatggaatcaaacattatagacctttttttggtaagggactactttgctattttttaggttaattcatgctatttaatgtatgaaattagatcatcatagtgtcatttactcaattaatgggctgactctgatatgaaacctcaaagtattcatgtatatatggagagagagagagggaggaaggacagagattttatatctgagacagtccattgagtaaatatatgacaatatattgatctatttgttgtcgatggattttacatttgtttccagtatatgaatattataagcaaagctgttacaaatacattagtgtaagtttctctatctatgttgtctcaattttgttgagaaaatatgaagtatgtttttctctattgtaagaggaagtttaatttttttcagttttattgaggtaaaaataaaatattttttaaaatgtataggtttaaggtgccccacttgacgttttgatgttgtattagtccattctcacactgctataaaaaatgcctgagactgagtaatttgaaaaaaaatatgtttaattggctcacggttctgcaggctgtacaggaagtgcagtggcttctccttctggggagagtcaggaaagttaggatcatggcagaagacaaaggggagcaggtgtgtcacatggccagagcggaagccacaggaagcggaccggggtgtggggggactgcacactgttagacaactagatcttgtgagaactcaggcactgtagtgagaacagcaccaggagtcggtgctgaaccactcatgaaagacccaccccacgacccagtcatctcccaccaggtcccaccccaggactgaggattataatataacatgagatttggtccaagacacagatccaaaccatatcatatgcacattgtgaaatgctcatcatggttaaggtaatttgtatattcatcttctcactattttttgtttgatttttgagacagagttttgctcttgtcgtccaggctggagttcaatgtcaccatctcagctcactgcaacctccaacccctggattcaagggattctcctgcctcagcttcccgagtagctgggattacaggagctcaacaccacaccccgctatttttttttttttttggtacttttagtaaagacagagtttcgccacgttggccaggctggcctcgaacagctgacctcaagagatctgtccgcctcggcctcccaaagtgctgggattacagatgcaagccacagcgcccagccaattttattattttaaaaatgtactgcatgtgagtgtgtgcgtgtgtgtgtgtttcatgagaacacctaagatctacccttttagcaaaaatcacttttacagtacagtattaaatacaggaaaattggcgtaggttagatctccagaactcattcaccctgcacagctgaaactctgtaccctctgaccaacttcacccaatttccctctcctcccaggtcctgggacccactattctactctctgctttcaagagcttgaatatttcagatcccacacgtaaatgagatcatgcagcatttgtctttctgcatctggcttattccactcagcgtcatgtcctccaggcccatccatgttgcaaaagccagaacttccttcttttcaaagctaaataaaattcagttttatgtgtacacattttctttaaacattctttaatctatggtcattaaactctttcacaaatctacactattataaataatctggcagtgaacatgtgtttaacataataattttatttcatttgaatatataacaagaagtgggatcaccagatcgtacgataactttatttttcaatttattgagtaacaagtcctaccacaccatatcatgatttcctttcccaacattcttgtgaacacttgttatattttgtcttgctgataatagtcattttaagtggtttgaggcaatatttcatcgtgctttagatttgaatttctctgaaaattagtaatgttgggaacctttttaggctctgtttttcatgagtgggttttctgaaaaaaagtctatccaggttttttcccttttatcaggtcgtttgtaatttgcacatagttttttttcctgtgcttttggtattaaattcaaataaatcatttctgaatcaatgacaggaagtttttccatgctgtctatgagtttgtggtttcaggttttgctcatttttagttgatttttgtacatggtgtgagagaaggtctaattttatttcttctgcatatggatgtccagttatacatcatttattgaggagactgtctttcttcactgtgtctttttggcatacaaaatcaggaagagacataattaaaaaagaaaatattagatgaatattcgtgatgaacatagacctaaaagttctcaacaaaatattagcaaatagaatccagaagcactttaaaatgtaacacatcatgatcaagtgggctttaccctgggatgcaaagttcattcaacatccacaaatcaataactgtgattcattgtgtaagcagaataaaagcaaaaaccatatgttatctcaatagatgctgagaaagcttttgatatgctccaacactcactcataataaaaaccctcagcaaactaggcatcaaaaaacatacctcaaaataataagagccatctatgaccaacccacagtcaacattatactgagtgagcaaaagctcaaaccccatgagaattggaacaagacaaggatgccctctcaccactcctattgaacatagcactgaaaatcctagtcagggcaaccaggcaatagcgaaaataaaacgcagccgatatggtttgtactagtgccccattcaaatttcatgtcaaattgtaattcccagggttggggctggggtctggtgaagggtgattctatcatgaggatgggtctccgtctcttgtgctgctctcgtgatggtcctcaggagatctggtttcaaagtatgtgtcatctccctcctctctcttcctcctgctcctgccctgtaagacatgatgcttccctttctgtcatgattgtcatgttcctgaggcccccccaagagccataattcctgtacagcctgcagaaccataagacaattaaaaacctttatacattacacagtctcaggtgtttctttagagtgtgcgaatggactaatacagaatcaaaataggaaaagaagtcaatgtatctgtccaaattgatgatataattctatacctagaaaattctaaagactctgccaaaataattctagaatagataaacaactttggtaaagtgtcgggatacaaaatcaatgtacaaaaatcactagcatttgtgtaccccaactacatccaagctgagagtgaaatcaagaacacaattctatcccacttacaatatccacaaagaaaaggaaatgcctgggaacacagataacaaataagatggaagatccctgcaagatgaatgacaaaacacagcagaaataagtcataaatgacacaaaaaatgggaaaacatttcatgctcatgattggaataatcaatattgtaaaaattgtcatactgccaatagaaatttacagattcaatactattcacataaaactatcaccatcattcttcacagaattagaaaaaaaagtatatatattctaaaagttatatggaaccaaaaagcccctgagtagccaaagcaattctaagcagaaagaaccatgacagaggcaacatgatacctgactttaaactacaccataaagtcacagtaaccaaaacagcttggaagtggtacatgagcagacatgcagaaaaatggaacaagagagaaaacagaaataaacctgcacacataaaccatctgatatttgataaggctgacgaaaacaagcaatggggataaaactctgtattcactaaacggtgctgggataactggattctgtcagatatacagaatgcaaaagtgaaggaggctgggcagcttcgacttagatttcagaggatatgtagagggccctgcaggcccagcaggaggccggctgcagcagtgcagccaccacagacagcctctactaggacagtgccaaagatggggaaagagagggttggagccccaattcacaatccccactagggcattttacactaaagctgtgggaatgtggccacgaccctcaaggtccctgaatggtagaaccaaaggcagcttgcactctcagcctggaaaaacttctggtactcgactctaacctatgaatgcaggccaataagctgtgctcagctataaggatgaaaagcctgaggtttctgggactccttcaacccagggtgccctggttgaagtacatcaagtgaagcgagattattttgtagctttaagatttaatatctgcccagacaggctttaggtgtgtggggggcctattggccattcctttggacatttttttccttttgtattaacaatatttaaccaatatctgtggcagtcttgcatgttggaagtaaataactctttaaaacattttgccagctcatagctggagggaaattgccttaagactcggataagactttggaattttcagttggaggttgaccaagttaagacttttggaaactattaaaaaaaaaagatcattttgcaacctctgaaggacgtaagatcagggggcacaagagtgaaatgatatagtttagatgatggtcccctccaaatctcatggcgaaatgtgctccacaatatttgaggtggggccgactgggagattttgggacatggggaaaaatccttcaggaatggctcaataaccaccctatggcagtaggtgaattattcctgtattaactactgggagatctgattattaaaaggagtctgatgaccctcctcccctctcacgtccacccctcaccatatgacaccgcctgcttcccctttgccttccaccataactgtaagcttcctgaggccctcacaagaagcagatgctggtgccatgctcctcacacagcctgccgaactctaagccaaatgagcctcttttatttgtaaattacttggcctcaggcattaatttagagcaatgcaaaatagactaaaacacactgcccaaagcaatatacagagtcaatgcagtttccatcaaataaccaatataattaagtacattttttttaaatgtcctaaaatttatatggaagcaaaaaagagccttttgattccatataatagcaaaagccgtcctaagacaaggaaacaaagctgaaagccccacattccctgacttcaaattatactacacagttataggaagaaagacagcacggtactggtaccaaaacaaaacaaaaaatattagaccaggtgtgcctgtaatcccagcactttaggtggcagaagctggtggatcacctgaggtcaggagctcaagaccagcctgaccaacatggtgaacccctgtctctagtaaaaatatgaaaaactagccaggcctagtggcccatacctgtaatctcagctacatcggaagctgaggcaggagaatcacttaaacccgggaggtggaggtttcagtgagctgacatcttgccattgcactccagcctgggtgacaagagcaaaactccatctcaaaaaaaaaattaatgtaacagaatagagagcccagaaagaaagccaaatatctacaaccaactattctttgacaaaactgacaaaaatatacactggagaaatagtcctctattcagtaagtcgtgctgggaaaattggatggccactcatagaagaataaaaccaggcttctatctcaccacagacaaaaagtaactgaatatggattcaataattaaatgtataaactgaaactataaaaatacttgaagaaaatgtagggagaattctcgggacattggcctaggcagataaaatatgactaagacttcaaaagcaaatgcaacgaaaacaaaaatagatgaagaggacttagttgaactaaagatcttctgcagagaaaaagaaataatcaacatggtgaacaaacagcctacacaatggtagaaggtatcacttcatctcagttaagaaggctcttatcaaaaaagaaaaaaaacagccaggcgtggtggctcatgcctgtaatcccagcactttgcgaggccgaggcaggtggatcacttgagatcaggagtttaagaccaacttgtccaacatggcaaaaccctatccctcctaaaaatgcaaaaattagctgggcgtgttggccagcacctgtagccccagctactcggtaggttaaggcaagataatcgattgaacctgggagttggaggttgcagtgaggtgagatcacgccactacactccagcctgggtgacaggagtgaaactctgtctcaaaaagaaggaaggaaggaaggaaggaaggaaggaaggaaggaaggaaggaagggagggagggagggagggagggagggagggagggaggaagggaaagaaagaaagaaagaacgaaagaaagaaagaaagaaaaagaaattaagaaagaaaaaaattaagaaagaaaagaaagaaagaaaaagaaggaaagagagaaaaaagaaagagagagagaaaaaaggaaggaaggatggaaggacagaaggagggatagaaggaagaaaaggaaaggagaaagaaagaaaaaagagaaagagataaaaagaaataaagagagaaagaaagaaaactaacaaatgctggtaaggttggggagaaggtaaactagtacagtcagtcactatggagagcagcgtggaggtacctcaaaaaactacaaatacaactaccaaacgacccagcaattccactactgcaaatgtatccaaacgcatgaaaataattatatcagagatttcttactcccagtgtatatggcaggacctttcacaatggccaagatatgaaatcaaaccaggtgtcagagagcagatgaatggttaaagattatgtggtgcatatacatgatgagatgctcatcatccacaggaaaggaaatcctgttgtttttggcaatgaagacggaactggaggacattatgtgaaatgaaataaaccaggaacttcaagtaatacaccttgttttctcactcatacgtggaaggaaaaagaaaatttgtctcatagaaataaatagtagaacagaggatactagagtctgggaagtgcaggggaagagataggcagagatttgtgaaggaatacattagagttaggtgggaggaatagattataatgttctttaccactgtgggataaatgtatttaacaattatatgtagtttcaaacagttagaagaaggatattgagtgttcccaacaaaaagaaaatgtttcagatgacggatatattaattatccttatctgtcccctacacactgtttcacaacatcgctatgtacctcatgaatatttacaatcattatttgtctattaaaattatattagaaaacacaaaattcactggaagtaacataaatggaggctctgggatagacctggagataacggagggtctgggatacattacaggcctagcactcaatggtcagaggagctcccattagctttttgtatttgtagcactgagtaaatctaacatttctcagagcttccctttgcaatagagacgtgaggcctagggagatcttgcagatagtcagatatgcagagggaagaagcaggggtagagggttgctggcccattcaacaatagttggaatgataattacgcatgtagagaagccaacattgatttaaataagttgcatcactgaaagccatgaaaaaaaatccaaaggaaatctttaaataaaattgagagtgaaactgttttgggtgaagaaatgttcactgaagttaggtgtgccagtaaagctgttaagaactacagtaaccactggattggattcagctttgtctgaattcagtgtgattattactggctcaggcaggggtcagaaatcaacatggataggtggtagcaacacgaaaaagccagggaccagaaagattcacagccgaattttttcagatgtataaagaagtgttgctaccaatcctagtgtaactatttcccaaaaatgaggataaaggtctcctccctaaattattccatgaagccagcattattctgataacaaaacctggcagagacttaataaaaaaacatgactttagaccaatatacctgatgcaaaaatgctcaatgaaatactcacaaactgaatacagcagcacatcaaaaagcctaacctaccaacactttgttcctgggatgcaaggttggttcaacatatgcaaatcaggaaatgtgattcatcacataaacagaacgaaaaacaaaaaccatgttaaccggcagggcacggtgactcatgcctgtaatcccagcactttgggaggctgaggcgggcggatcataaggtcaggagctcgagaccatcctggttaacatggtgaaaccccgtctctactaaaaatacaaaaaaattagctgggcatggtggcgggctcctgtagtcccagctactcgggaggttgaggcaggagaatggcgtgagtccaggaggtggagcttgcagtgagccgagatcacgccactgcagttcagcctgggcgacagagtgagactctgtctcaaaaaaaaaaaaaaaaaagaaagaaaacgttaaccatagacacagaaaaggttttgaaaaaactttaagattctttcatgttaaaaaccatcaaccaggcatgaaggaatacaccacaaaatataagggccatctatgacaaactcacagccaacattatactgactgagcaaaacctggaagcattttcccctgaaaactagaacaagaaaaggacacccattctaaccactcctgttcatcattgtcatggaagtcccagccagagcatgcaggcaagagaaagaaataaaaagcatcaagtcaggaagagagggtgtcaaactatccctgcagatgaaatgatcacattcctgagtctgtagtttggtgactgacattaatttaaaatattgtcagtcatcattgtttaaatatttcttcttagcctttctctatttttttctatttcccattatgtgcatgttatacctctgtcactgtctcaccattcttgggtaagctgttcttcttttgtatatatgtgtgtgtgtgtatatatatatatgtatatatgtgtgtatatatgtatatatatatgtatatatatgtgtgtatatatgtatatatgtgtatatatgtatatatgtgtatatatgtgtgtgtgtgtgtctgtgtgtgtgtatatttgtatttgtgtgtttactgttctaacaatatattttttgtttttgcttttcagtttgggaaatttctattgagatagttttaagttcagatttttgtccgcagctatgccccatctacatataagtccattgaaagcattacttaattctgttacaaaattcttgatatctacttttttttccttttttggaatttgcttcattctacttgcatgacacagctgttccagcatgctgtctgcttaattcattacagaccttagcatattaatcacagtggtcttaaattctttgtttggtaattccaaactaaatggcatggctgaatctcattttgatgcttgttttgtcttgtcacactatgatatatttcttttagtatatatcatgatttttatagggagaaattatgtatcaggtgaaagaaactgctgtaaagaggcctttagtgatatcattgtaagttgtggagagaaacctgtttcataatcctctggccatggcttcatctaggaagcttaaggcctttgaaaataaatccttacatgaacgtgaaaagataagccacagatatggagaatttcctcacaaatcaaatatttggaaaaggacttttatcaggaataataaaaattaccttacagttgaatgacaaaaccacatgatctaattttaaaatagacaaagacctgtatagaaagaagcctcatctaaaaataaatataaaaagtgatcagcatgatttttaggtatatgtatgtttaatattcaaaaaatactatatcctgttagaatgggtaaaatacacattttagacagtaccaaatggtgatgaggaagttgaaaaacaggaacattcactccttgtgggtgggaaggggatgctgaagaggcacatacacaactacagttagtactttattgtatatttcagaatagctagaagataagatttagaatgttcttaacacaaagaagtaatcagtgatggaggtgagggatatcccaggtatctggatttgatcattgcagataacatgcttttatcaaaatatcatgcgtatcccttaaaggttttgaactgttatgtatctatataaattaaacatttttaaaaaaacggtgcaggggaatccagctaattgcagattcccattagatgggatgtgctgcataatctgtaaactaatcagagtctgtgggtttgtaaaggactttagaaatcaactggactacttgtttctaaagataagtctcgcaagtttaattattttcttaatgggtggcgattttgaacatagaagaaatgttaacagttgtttctcaagttttcttctagtttcagaagaaaaggtttgcagggaggaatctgggaccatctttcaagtctcaacttcaatgtgattatctcagtaaatattttctgatacccctgagcagggtaagtctcatatatgtcctagaaactgcaagtagaattctaggcaccccaactgactgaagggaacttttctcttcaacgaggagttccatggacactagaaaacctagtttaggccgtgtcagaaatggaggatcagaaatccctcattataccctcctccctttggaattcaagcacaagtaaccagcattttccttaaaacagatttaaggctcagaaaacagattccgtgtagcagtaaaacaccaaattctaacctgactcaagaatagcatcacatgacagagaaaaggccttggaaggaatcaaagtcttttaccctaaaatatatgtctttgacatatttttaaatcaccctgcacagttatctttttgcaagagaaatttacattctgtagagaatcgcttccctttgaaggtgtttgtgttatactgaggtatcgggggaaattcagccagatactgggagaaattcacccccgatatttcacgtagattcttttctattttccttaagtgtcagccggtctgagaaataaagggacaaagtacaaaagagagaaattttaaagctgggtgtctgggggagacatcacagttcggcaggttctgtgatgccccctgagccgcaaaaccagcaggtttttattagtgattttcaaaaggggagggagtgtacgaatagggtgtgggtcacagagatcactgcttcacaaggtaatagaatatcacaaggccaatggaggcagggcgagatcacaggaccacaggaccagggcgagattaaaattgctaatgaagtttcaggcacgcattgtcatcgataacatcttatcaggagacagggtttgagagcagacaaccggtctgaccaaaatttattaggcgggaatttcctcgtcctaataagcctgggagcgctacgggagactggggcttatttcatccccccgctgcgaccgtaaaggacagccgccccccgaagcggccattttagaggcgtttagagcgtttctgtcttctctcccagtttctacgagttcctccagtgcctgtaacacagagctgttagtggctttgcccctgcctgttaattctttggtcatgtaatggtggtgagggagctgggtctggatgcatttcagccacagctgctgttccacttccccacacagaaccatctcgggaggaagaggttggagatttttctgatgtgtcctcaatcctggcagaaaaggtttcaatagcaataggattccctcagttgtatgtcctctgataatttaaacaataacttctttattatactcaactctaaacggtctaaagagtatgtctaagttaaccctgcattcgcttatatgacatttgctctaccccagataaggtcatattctctttctgtttgttcctgcaagtcactgactttcacaagatgtaaggtcccttgtttgtcctataacatcaataatctgatgttttaaagaaaatatgctaatttgcagctcagtaagtttagttgtaaaaataatacatttttttctgagatgcctacatctccatgctgagttggagctttatttgtaacactcagaaactggaaataacaaaaatattaaggagctttataaatagtacgggcacactcattaactggaattctgttcctcattacaaggaacatattctttatacacaaccaaactactgactcacaagtaattgtgctgagcaagaagccacacaaatgaaatggaaactgtaaggtttcactttaaccaaattttgaaaaatagacctgaagtagcaaacatgagagactgactcagtgtagtgagcggaaaatgactgggaggcaggaattagaggaaactagggaaaccttgaagtgtaattcattgttatcttgattgttattttggatgcacaggtaagcacatgtgaaactgcattttttcctttggagacatggtcttgctttgtcatccaggctggagctcagtggtgagatcatagctctctgcagcctcagaccctgcgtctccaccaatcttcctccctctgccatacgtagctgggactactggtatgtaagacaatacttggcttcagtgcttattaaaatgcacactttaattaagcagtatttgttatacagcaatcatgcctcaataagagtattgcaaataagtggatagataatttgttcaataaagattgatggaaagatagatgctaacatgagaaaatgcatgacacccaagaaaataacactgtaggaaacatgcttttctttacaattgttaggtaatcacaacagagcatacacatcacaccatgttctcgttacagagaaaaggttctgcaaacctcactagctgcaacccctgtgtgctgggcttggttcagggagaagtcaggtccagtggtgagaagcacaggcccagataaccaagctcactctgaccgaatgtgagccctgggtacattgtacaacccatctgtgcttctgctggtaatttttcatctgtaacatggaaatgacattgatactatataccatgtttcctctgcatatgtaaaaataaaaggtgattggtgctaactttaaatatacacagtttatgtacattgattgcacctcaatacaacagttttaaatagatattacaacattataagttttataggtttaatattttatcacagaacaaactttcaataagaaaccacaatttccaaatgctatcaatatcacaaatctcccccaggacactctcacatgctctgagccccactctctcctcaggcgtcccatcccagagcttggcatgtagtaggagacatgcaaatagagccctccctcggcttatgaaaaccagcccagccctgaccctgcagcactggaagaggagccccagccctgggattttcaggtgttttcatttggtgatcaggactgaacacagaggactcaccatggagtcatggctgagctgggtttttcttgccgctattttaaaaggtaattcattgagaactattgaaattgagtgtgagtggataagagtgagagaaacagtggatttgtgtggcagtttctgaccagggtttctttttgtttgcaggtgtccagtgtgaggtgcagctggtggagtccgggggaggcttggtccagcctggggggtccctgagactctcctgtgcagcctctggattcaccttcagtgactactacatgagctgggtccgccaggctcccgggaaggggctggagtgggtaggtttcattagaaacaaagctaatggtgggacaacagaatagaccacgtctgtgaaaggcagattcacaatctcaagagatgattccaaaagcatcacctatctgcaaatgaacagcctgagagccgaggacacggccgtgtattactgtgcgagagacacagtgaggggaagtcagtgtgagcccggacacaaacctccctgcaggggtccccaggaccaccagggggcgccagggacactgtgcacggggctgtctccagggcaggtgcaggtgctgctgagggctggcttcctgtgatggtctggggctgcctcattgtcaaatttccccagggaacttctccagatttacaatcctgtactaacatttcatgtctctaaatgcaaaacttttttgttctttctgtatttttgtttttgtaacaggaggacacattctcgcctccacagaagccacagtgtcactttgggggcagatgatccttctgtagtcagcaggatgaaagtgcagaggaatctcagtggaacctgggaagtcttttccagttagactcagggcagagacctccatgggaatctctgattagaacaggctttgagttctgataggagccaagagagaggctcacccagggtcagagtccttaaaacctgacggttttcacagctatctcacctcgtcttgaaaaactgtgcacatctgactcacactaattcagttgaccttatttctgctaatctattttccttctctgcagacttgattctcacagttccctttcttcttctcttgcctgaaaacagaggatgtgttttctgtagtcaaaatcccagagatcaggtctgcaggacctgggtaggctgaggggactttctcactcaccatagcctggtgacactcctgctgtattttgtatgtggaggtgtttggaaaacgaagtgaacattagtcatgaagggaataatactagttttctccaaagggatgtggatgtagagctgatcttgtgcttctcacactgtcacagaatttatgctctcccctgtgactttaggagagctgaggatggacactccattgtgctgtgagctctggtaatagtaattatagggtctcgctaggcagcctaaggtcaatactgctggccttcgggaaaggcaggctgggattcctaggaaaacctgcatctgccatccagcatggagtcccatcgtcttctgttatgctctgattgaatcaggcacacctaggttatctagaacactcttcgtgacttgggaaaaattagtggcaggctctactaagacctgcattatgccatgggagcaacacctaggctagtgtgtgattgagtaggtgagactatggtctagtcaaggtgacagggaaaattgttgccattattatgttttattttatatttggcaatatagtcatgctcatattacaaatatctttctacattttttgtgtcagaagcttttgaacaagagcaacttcatcttgaatagaggctaggaaaaataagactgagacctgctgggctacattcccagtaagttaaggcgttcttagtcacagggatgagataggaggtctgcacacgatccaggttataaagaccttgctggtaaaggttacagtaaagaagctggccacagcccaccaaaaccaggatggcaaaaaagtgatctctgttcgtcctcactgctcattataatgccttaacatgctgaaagccactcccctcagcgccatgacggtttacacatgccatggcaacatcaggaaggttccctagatggtgtacaaaggaggggaggacacctcagcttcgggaattgcccagggactcatgaataatccatccgttgtgagaaatacattcatccctttgagagaaaatgcacagggggtggaatgaggctgggaagccgatggcacatggtggaagcctgtccctgagtgaaagagagggggaagctggattgggtggaaggtccctatatttctgtgctgtgcaagggaggggcaaaatataattgagtctcttgtaagtcagtgtttcctctcaggggatccccatgactcccagaaataatggctctgcttaggaatccctgcagagtcactcctttcattagagtagaccacaggacatgggcctcagcacacgccatgccacagatgtcagaaagcagctgctgggaacctgacccacctgcattttgctgcctgtaggaggaggaggacgtgcattctcagggccaacacactgtttttggatttttatagagaacacctgcttttactttattttttggaaaaatatatgaacaaatgtgcacctgcaaacaattgtaattttcacatttattttaattgcatttgtttataattgtgcatgaggtcctggtgcagagttgagtttttcatgggaattgttccaagaatcaagaacatccattttccactttcactggtttttccccatgtgcagagaccttgagtagagcacatctggcccttatccacactatctcttgtgtccccgggaaagacagggatttgcctgactgcagaatctagggtaggagtctgcacacgtctgagcctgcagagaagcccagtgaagtttaatgaagtcagagagctttcccgtgtggggaacctctagcttcctcactctcagagattgctggtcagctgtaattgaggggttaagaattagagcacctgggagcctgtctcatcacagctccattctgtaacttaccaccatcagactgcaggtaataactcaatcttgatttttctgaccccatcttattcatttgtaagtttggttatacaaaatgttacattttagtttctgattcaaacctcagaattttgtgaattcatcaggaataattaaaaatgtgtccagtttttgggaaatgtaaattaatgtccatactgtttatgtgtgtgtgcgtgtgtgtgtggggggatatgtcagtcacttacaccccagtaaaaatgattccttaattatatagtcgaactgcaattagatttgctgaaaattgtctacagtaatttctgtgaagctgaccttgccaccttgctgtgaggatgctcagtgcacaggtgaggtctcacaggagagatccaaggttcagcccccaggactggctgagctcctggcttggagccagacataggactgggcatctcagaagcagatcccctggccctcctttatctgggctgtatgggcagcagaggacaagcagaagaaactcagaattcagccaagacagagccccatttaggagcaggtgcatcaaggaaccagccagagaacctctgactacaatctagggttgtcttcttttgcttcacagcatccagtcctaaggagaccacccactatatcatctgtaactcagaactttcttgttacaaaggaaaacacaaatgaatataactctgcagttaacttcttgaacctggattgatgagtttccacggccttatgagcacagagaccacatccagtgcaggtgcagagcaaggctgcaacagtcagcctgctgctccctcaggagtcttccaattcccttgtccaaagcatccgctcattcatgggctgagaaaagggaagtcattcatgcagtctactctctccacagaactgacggggcacaaggacaacatcgatttttcatggaacatgcctctaggaatgcagctgtgtgcacacacactgctaagcacacacttctttacataattacttgtaactgtattttcttatttattctctccaatttttttacacaaattcatcacttttccccataatcaaagaggattttgatcagaatgcttgtggggagccccttgccccccagatgcccaccatcattattcttgaagggaggaggaacggcagctctcttgatttctactctaatcctctaggactaaaaccagaaggttgcatgtccggtgcgggagcatcgaagaagatcctgtctgtagaagcaggagcgtcaagacttgactgagagccatggtgctgaaatgagatagattccctgatggagagcacacgtggacccccacacctgagggctcactgctcctcaccacagatgcactcccctactgagtcctgagacctgagtgcaccccatagagtagggctcagatgaggggatgcaaatctccaccagctccaccctcccctgggttcaaaagacgaggacagggcctcgctcagtgaatcctgctctccaccatggacatactttgttccacgctcctgctactgactgtcccgtcctgtgagtgctgtggtcaggtagtacttcagaagcaaaaaatctattctctcctttgtgggcttcatcttcttatgtcttctccacaggggtcttatcccaggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggataccacagagacacagcccagggcgcttcctgtacaagaacccaggtgtttttcagtggtgctccctccccacttctgcagaacaggatagtgtggctgagatgccatttcctgcccagggcgtgcgtttcccatccccatctgactcagagccttgttttcctcctttttctttactaataaatggcatgtcccctgttagtggttcatgcaagcagaagctgtatcctgtttgacaaagattcagcatgaaaggtcctgctacctaaaaaaaaatagacagatgagatttaattaacctaaataatttttttcacaacaacagagtgaatacgcaatttacagaatgacagaaaacttttgcacactttgcctgtgacagggaactaatatgaagaatttgcaaggaactcaaacaactctacaacaacaacagcaacaagaaccaaataactccgttaaaatgagcaaaggacatgagtagacattttcaaaagaacacatagaaatggataataaatatataaacaatactcaacatcactaaccatcagggaaatgcaaattaaaaccacaataagatatcatcttccaccagtcacaatgactattactaaaaactcaaataatatcagatgttgctgaggatgggaaatgaaggcaactcttagacattgttgatgaggatgtagatgagtacaacctctgtggaaaatggtatggagatttcccagaaaactagaaatagaactgtcatttggtccagcaatcccactactgggtaactacccaaaggaaaataaactattatttcaaaaagatacccaccttctatgcttaccataaaactactctcaatagcacatatgtcaaactgagtgtctgccaaccgatgattttataaaagaatatagcatgtatgcacaattcaatactagtcagccacaataaggaatgaaactgtgtcttttgcagcaagatgcatagaagtgggggacaatataattagtgaactaactcacaaacagaatgtcacatgtcacacattattacttgtaagtgggaggtaaacagcgtgtacacaaggatttgtagagagaaattacacacattggagacttacaaggatgggcgggcagaaggtgggagcatgatgagtcattacataacaggcacaatataaaataattaagaattgaccaatgatcttaaaattaaaatgtagaatatgatcaataaatgaacttgatattagttgacctcattaaatttaaaaactttttctactcaaatgactgtaagaaaatgaatgcccggttacagatgagaaactgtttgcgagtcaaataaccaccaatgtaactataataagaaacttcagaactcaactgtgaataaaaaagaaacaactgatggataaattaggcaagggtttctacagacatttcgtcaaagaagatgtgcagatgacactgaagcatataaacaggatctcaacaggattttccgttagagaaattcaaatcaagcccgcaaagagacaccactgtacactttttaaaatggctgaaattaagaagaaatacagataacatcaatgctggtgagcataccaggttgctagaggctaaaacattgctaacaggaatgcaaaatgaaacagatactcaggaaaataatttttagttttctctaaaatcaaacatacccttaacacctgaatatttgcatcagagaaaaacaatcttacattcacgcataacttctattcaaatattcaagatatcgtgtgtatgtgtgttagaaagtaaaaataacataaatgtctcaaaatttgaataggtgaagaactaggaagcatctataaattgaataccaccagcaataaaaaaataacaagtgaccgatacataaactattacaggtgaactccagacattgtgctaagtgagagaagccagtctcaaagatcaaagggacacagctgtaagcaccacggtcatcctcaggtgtcagtggtttgggctggactttctgtgtctctttcctgaccagacccagatattgagctccaccacttgcagatggaaaatcctattttcaaccatgcagtgaggtttgaactgcttcacagactgaacgaaacaaacacgggctcctttgaacagcgtccggcatttgttccaaccacaagagaacgtccctcagctctcccacctcctcggttctctcctgcaagccagcagccctgcagtttagcctgcatctcccgtgcatccacccatctccctccaagcaccttcccccacaccctccactgtttctgagagcacaggcaggctttgaacttttccgcattctgttgttattgaagttaggatgtttaggaccaacttaaggatcatattttatgactgaattccagtgccccttctctcctgggacagagtgcataaccaagtttctgcaggtggagacgaagttgagcttttttcttcctcagcctaggagatgagcgctaattggagggttggcagaagcttcccaccatcccagcactttggttctggtggggcggaatcggtgccatagggcagagctagaaaccgcggactgaatgttcccagtggcactggacccagggcagagcctccatccacgagtggggctctatggaagaagtgagtctctggctctcagtagctctcgtccagcactgaacctcagcatcatgtgctgtgtgcagggtcagagggccaacgtactggcccctgggaaagcgtttcctctggtgggagttggtagaaggtgtcctgtcttcttggctgcatctgtccgcagtggagtttacatcatgctgagctgggatgtggaaggaaggaagagcatcttagatcaaatatgatgactggccttactgagttttctagattttcctgaataaatgtttcttcactcactgtgtgctgttagagtctttccaaacctgtaatttcccaaaataattttcactggtctcatgagggcatggattcattgagcccctcatgctgtcaaagagaaatagaactgtttttttttttcacttcatagcgaacatccatgggttatcaaataatgggctggcttttcttccaacactttacagacaccatcaattttcttcttgcttataaggttttaaccagaagaatgctgtcatggtcttttctgttcttttggaaggaatgccccctctactcacctccacttgtctgcctgtatttctatttgtctttggttttcaacaattttaataagatttacctaaatgtgtgtggggggagcatggggtgttattctgctgttctgtgttctctgagatgcatggattcaccatttactctgtctccatttttgtgaaaacaattagaaaaaaagtcagtatgagcccagaaacaagcctccctgaagtgggcacaggaccacctgggggcgctcaggacccactgaacacaagagccagccccagggcaggtgcagatgcgggttaagttctggtttcctgtcaaccctgtggcttcctctccataaaacagtttcctttgtggcatatctctggattccttatcctgttcttcctgtgaagtctctgaagaagaaacatttgtcgtaacaagagaaaaactttctcacatgcaccaaaggcagagtcacctacagtcacttactcctgtttctcaatgtcaataagttaccaatgcttctgaagttaatcagctaaatctataaaaggtgcggtgtttaactcagcattacagcccagctcaacagaactccaaaggtcagccagcagcagccaggaaaaagtgcatgctgggcattggggcagagggagttaccatccagtgcaagagaagaaagcccccgtggtggtcattgtcaggactccaatcccacagttccaattgtaggtgatgccaggcaaaggaagagagaccccaccaatggttagtgtggatgtcgagtttgatgtttccacactcacactccaggtgaatatgaaaagatttattagctctatttctgaggtgtctgctgagagcagcacagtcctctcaagaaattacagattggaatttcctcagtagagcaggaaaggaggctggctcagggctttataatgatttggtggtggggtcggcgggggggggggggcgtttctactcaggagaaggagcttgtgtgatttaaacctcacactgacatcacatgagggagcttccatgatttcttactagatttcccatgtgtgggggacaaggatgagggagaataaaccttaattcatcagcatcaaggcaccaaaaataggacctgacactttattctccctagcagcttaagaaaatgagtgaaaaagagagataagagtccacccatgtgctgaaaagcatagctcttggtaaagacgagaaaaaggcactcctacgaagaaggggttgggcagaagctttatgctgaagggtttggctaaagagacataatcaacaggttacaggaggggctactgatgttcatggaggtggtcctcacacatgcatactgaacaaacatgtctgtaacgtatgacccctgttcacttaccagtggagacttagcatttaaattcattccagtcaggccctatgtgcaaacagcagaagcagagacacaaaggtactcagggtgcagcctctgtgaacggccagagccaggccatggtcagcggtctcggattaggagaaagttcctgatatcactgtagtgttcaatcaaagctggggttatggtttgtggaacaggggtcagttcatcagggggtgggctgcaattgtcttcatagtgcttgtctcagtgccggtgcttactgagccactagagaaaaaggtttaattgagcttctttaaaatcaacattttgaattatttatcagacgtttcaaatatgtcatgttgtttagattctattgctggagagttaaggtgatatttggggttttgtaactctgttttttcatacttcctgaattgcttatctgtttgcttttcattagctaaactatcgcttcttcttattttttaattcattctgattttgatgaatatttaattccctttagaatgtgaatataatgtacattgtgtgggtattttgattttggttcttggtttacttagtggcaaagactctgtaagagttccttgtctatagatagccattatttagtggctttctgaaatggtggttttagtaccaaagtactggacttgtgagtaggctcactgccccctgcaggtcctagatagtggaggcctcaggaactgtttctcatttggaatgcctttgtttcagcagattttgtgttgggttgttaagttcaccctccacattagtagatgtccttacagattagagctgactctggtagaagcagttgagtgcatgcttgatatctgtgcacagggagaagctctctgttgcctcaggcgatggactggtctatgaaatgcacagtgacctgagttccctgctcagcccctgagaggtggaccaagctggacacacatgagccaccgagcctggcaagcaaaagcgccagccttgatggaaatggcgagctgagcggcatctactcagtgtggtttcttttgttattaagagctttagtgtggtggctgtttcaaattcccgttgtagtagtaatatactgggtatgtgagcaggcccgtggtcttttgcggggttggaatcaccgaagtaatgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttactggtgattaaagtgggaaacttggcgtgttccagatcttagagaaaagatttttagttatttctcattcaacctgatactacctgaaagtctctcgaatgtaacttttattttgtcgagatgggttctttctatacccattttttatgttttttttgtgaaaggatgttgtttcatcaaatgcgttttcagcatcaattgaaaaaagttatatgtggattaaagatcaaaatgtaaaacctaacactataaaacctctggataataacataggaaacagaatttaggaggtaagaactgacaaaggttttataatgaaaatgctagaagtagttgcaacaaaattgaaaattgacaaatgggacctaagtaaattaaagaacttctgtacagcaaaagacactatcgacagagtaaacaggcaacctacagaatgggaaataaaatatttgcagcctatacatctgacaaaggtccgacacttagtatatacatggaaatttaacaaacatacaagaaataaaaagtgaccaaaggacatgaaaagacacttcaaaaaagacctacatgtggccaacaagcataggaaaaaatgctgaatatcactatcattagagaaatacatatcaaaacctcaatgaggtaccgtctcacatcagtcaggatggctaatcttaaaaaaaaaataacagatttttaaggttacagaaaaaaggggaaatttatacacttttggcgggaatataaatgagttcaaccattgtggaaagcagtgtggtgatccctccaataacctaaaacagaagtttcatttgacccaacaatcctacaactggacatatacctaaaggaatataaacatgtaggttcactgcagcactatccacaatagcatagacatggaatttacctaaatccccatcactggcagaatgatagagaaaaatgtggtacatacaaccatggaatactatgcagctaaggaaagaatgaaactatgtcctttgtaggaacatgatggaactggcagtcaatactcttagaaaactaattcaggaacagaaaaccagatattatatattctcccttatttgttggagataaataaaagcaaatattcttccagggcctgagtcttccttattcaacaagtcattctaaattaagtgttcagcaagttgctgatactcatctaaatattctatttcatctgggccacttacatcactcaaaaagcaatgagagctatatttctaaggggggttctaggataataaatacctgaatagtgagaatatgaaggatatggaaactgggccacttatatcactcaaaaaggaatgagagctatatttataaggggggttctaggataataaatacctgaatagtgagaatatgaaggatatggaaactgggccacttatatcactcaaaaagcaatgaaagctatatttacaaggggggttctaggataataaatatctgaatagtgagaatatgaaggatatggatggtttttttttaactcaatgggcacataactgtgggagatactatattcctatgaagaaggtattcagacttcagagataagtaatgtttcctacattgtgcttgtgacttggaagcagtggattgaagagtgtgataagtgcccagaccaagcagaacagaaatcagcatgtaaagatgatgatctatggatatgatctaaaaccatgtaaatacttcaaataattctatttaatgcagtttgaaataaaacacaaacttattcaaaatacaaattacttggtaattattttgggagctatgagttcaccaagaaactcaaattcctatttctatttcaacccctgattcctactgtcaatgggagggaagtctcagaaccaatcacacatcagacggcaaatctgtcaaccaagagtctttccactgaaggacctgggaggtcaggaccctcaggaaagtgctggggaccctgtcttgggagtgcccagcagatctcagaactctccatgggtcctgctggacactcatgtagggtaacgagtggccaccttttcagtgttaccagtgagctctgagtgttcctaatgggaccaggatgggtctaggtgcctgctcaatgtcagagacagcaatggtcccacaaaaaacccaggtaatctttaggccaataaaatgtgggttcacagtgaggagtgcatcctggggttggggtttgttctgcagcgggaagagcgctgtgcacagaaagcttagaaatggggcaagagatgcttttcctcaggcaggatttagggcttggtctctcagcatcccacacttgtacagctgatgtggcatctgtgttttctttctcatcctagatcaggctttgagctgtgaaataccctgcctcatgcatatgcaaataacctgaggtcttctgagataaatatagatatattggtgccctgagagcatcacataacaaccacattcctcctctgaagaagcccctgggagcacagctcatcaccatggactggacctggaggttcctctttgtggtggcagcagctacaggtaaggggcttcctagtcctaaggctgaggaagggatcctggtttagttaaagaggattttattcacccctgtgtcctctccacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagacacagtgtgaaaacccacatcctgagagtgtcagaaaccctgagggagaaggcagctgtgccgggctgaggagatgacaggggttattaggtttaaggctgtttacaaaatgggttatatatttgagaaaaaaagaacagtagaaacaagtacatactctaattttaagataaatattccattcaagagtcgtaatataagccaaattcacagagtggaaaaggccacactctataacgttgatacaaacattccatgaaggtgctactgtgaacaagttttcaaattggatgaatacatgatttggagcaaggttatttgatcatgtggtgagactaagaatgattcttaaaaagtgccaaaagtttccttcaaatgtttctgtcactccttatcataaagtttattttacagcagttttaggattacaaagaaattgcacaggaggcgtgagaattcccatgactccctgccctacacaggcacagcctcctccactacgaccatcctgcaccgcagtcacaaatcagttacaatggaggaatctccaaggacgcttggttctttctttttctggtgatctcctaatataacaagcctaagtatctcaagattccacggttttttcagtgttttctagaactgatattagtcagagggaaagtgggtaaggctattactatttgaactctttcttccaaaatccacaaaatatatattaatttagagcttatcttacttctggtttacaatgctccttcccagagagtaagatttttaagcttttagaggccagttcatgtctctaaaagaccagaaagttctggggaatcccataatgaacatcctttcattggaattggagaccctggcaatgagagattccatgtataatgccctagagttggattaggtgcactgtgagctcttgggtggtgagtctgagtaaggtggtttgtgcagcaaatgcaaacacattcatgggacccaggtaggaacaaaagcttccctctgcaaagggagtgtgcacctgaagcagccctcacagaggtgggcactgcttgcccttgatgagtgcacattagccagaggcatgatcatgattggtcttgcagataaagagcaccactgaggtcataggttatgaaaatgtttgtcatcctccagctgagcaagtccatctgcttgtttgtgggtgtcaactccatagagggtgcactttgggagatgacaagatgcgcacaaacctgctctcactaattatccactaccacacactcaagaccaacctgtgctccggaaaggaatacgtgcctgtggaaatagacagagcttaagtattttgtaacctggtgaacatactgcccaaagccacacgtttcaggaagattagctcagaaatgttcaccaattgactgaagggcagtggcgggtgaggtgatgggacagcctcagggctgcacatgaggagggctccctcccccatgcaggcttttcctccaggagctgcatcaggacctcaaggaagatcagggagaattctgagaacacccttctgtggagctgcctagagaagaagaataaatatgaaaaaatacaactctgagtaatgcatggatatttgttcatgaaaactctctctgaaagcttgtgaaggtctcgaaatacccctgattagctgaagacaaacatttaaaccctccttccacagggagttcaagcaggctggatgtgtccttctatggatgatcttccccaaccccttcctcttcccagctcatccctggctctctgtgtaaacagttctcatcagtggaatgtggttgatgaagtgacgtcttcaatttcctcatcttcttggtggtcatgttattttttttcatctgagggttaaaaactcacctgcatgcagcacatgacaggctaaaatctcttgtggacaaaacggtaacaaaggcacccaccagggttgagcatccgtgttgctgacaacgaccaccaggggtcaacgtcctcttcacaatcctgtgtcagagcatcactggaatgatttcattagcaacttcccaggagaatcagcttaaaaaatacttgtcccattttccatgcagatataacccatcccttttcctgaagaaacagagctcaatactaaatacactgaatgttgtttttgctggttttgtaagtttgtgactttatcactttctaatttctgagttaggtggaccactctacatatttctctcatgggtgtgaccagccttctggatgtcaaatataactgactttgttcgtgtaaatgtcaacacaagctcttcatggtttcggtgctcactgactactctaaacttacacaatgtgtttctttattagctttgttttctggtatctctacgtggcttattcatcacgcccattttatgttacttgtacaggtaattgattgttatttttaaaatttactattgcttactttaattaaataagtaggcaatagcttagaatagaaaataaggtaaagtaaaagtacatgcagtaatatttaatataagtaagcaggcagctgaaagcaagggaaatctactctgctgtgtaaaagggtatggagacctcacagtatgatgatcttctgcagtttaatccatactgctacataagtgacaacgtccactctgtttatatcagagcttcccctaatatgtacaatgaagactgagcccaggtacctccaaccagaatggccagcaccttttaccaagtgcctgaactgacagcaatagagatcacgtttgtctaaaaaaaaactcacactgtaaggatacccaccagtcatatggagacaattagaaaaaattaaagcccaagcctgataggtagtaatttgtacttagaagaattaacttttatctccacatgttttttttttaatcatagagaaactactagtggtagttccactgtccaagttactgaatatcttattcctagaatgagacactgcacaatgtgttctgacacgacagaacgtagctgtagttaagggacaggagatgtgatcacgggaacacgagtctgcgatccagcagttcttgctccttcacatttgcccagaaacaaagaccccagcagaacaatggaagcattgacttaggtctccacagtctgatgtgagataaacagcaggtagtttatgcctctgttttatagcaggaaatttaatctctaaagaagggccattttggagataatactattctccaggatgcttaaatgcccccaaacagagagcactgcagagccccgtggccaggagctacaacacctgggtctggaaaccactggacagaaatatgagattctcttaccacatgtatgatggaaccttgaagaatgtttccttccttctccataatcacagcctgcgatgaactggaggtcccagtacataaaaaaacatgtgtctgcattggatacagaattagtcccataaaataattgtgctactgtggtgctcacactgttggaccagctgaccaagaaagtgttgtaagagctgcagtgtctactgattcctaccatatttggggctacattcacatctatcaagggaaagagagataagaaaatctctctaggccgggcgcggtggctcacgcctgtaatcccagcactttgcggggccaaggtgggcggatcacgaggtcaggagatccggaccatcctggccaacatggtgaaacctccatctctcctaaaaatacaaaaaattagctgggcgtggtggtgggcgcctgtagtcccagctactcgggaggctgaggcaggagaatggcatgaacctgggaggcgtagcttgcagtgagccgagattgtgccacttcaactccagcctgggggacagagctagactccataaaagaaagaaagaagaaagaaagaaagagagagagagagaaagaaaaataaagaaagaaagaaagaaagaagaaagaaagaaagagaaagaaagaaagaaagaaagaaagaaagaaagaaagaaagaaagaaagaaagaaagaaagaaaggaagaaagaaagagaaagaaagaaagaaaaaggaaatctggcctagtctattgatttattttcatttcttcaaaatgaggtaaaaaaatcgcatcaactaaaatgcggacgatgatgaagtgatcaaagacaacagccactcagtgtttcaggtgtgttttaacccaaagtcacacaacatgtgagaagctgaactccggagccaggggcatctctgaggagaatgtggaaggtgggcgggaggaaacagtgattcatgtctagggaaatttcagggctgcctgctctaggggaaaggaaagcctgagcctctcccacagtgtgctctgttaaaaattttggctgacttattgtattcttcgacacaaatatttttgtttcgtcctcttttaaatttttttatctctattaaaattctcactttgttcttgcatgctgccactagcttattaaacatgtttctaatatttacttcaaattttctgccaggacatccatatgtttttttattcattgatgccagattctggacctctatgttgtctgtctgtttggaccatgttcccgtgtttcttcattttccttgacggtctttcttgctatccgttcatcataacaaacagctctttgctcatcataacaaagagccacactcttccaagcctaggctcatagagacaaccctcaccaatcactccatcagtgattgcggatctctcaaaacttcataatgacttcataatattccaacttctgtctctgttcttagtggcccccaggtttagagaacgttgggttgtgccaggactcccaaataggagaggtagaaactatatactcaagtagcctcttgaacagtgtaccattagacacagttttattattgaggtatgattcatcaaaataatgttagttcaagcgcctctcaaccagtcatctaacattgaaatgttataatttcttatttggatctctctggagtttatcttttgaatatttaggtaaaattacaaactagtataaagctatttggcaaaattatctgctgcagaagtttcatcttctgtgtatctctttttgcacttaaatatgtttttattagtcatgtatccagaatatagaaatatgtcttaaagttccttcatttttttaaggttatggggttttcagaagaggtgagaaccttctttatttataaaatacctgattccacattgctggatagtttcttctttaatttgtctcctcctctcacattatactatattaagcaaggagaaatcaaaacacaccatccacactttgcttagaaatccccaaagctaaattttaagtatcacttactaattctaattttacccattgtaacttaattaacatgaaatctataacaaggttacacatactttcccgttctaataccatgttcgtgacagaaacaaagcaggtgtcttctctgcaatgtggtcatctgaggtctgagatgaggggtcacacaggtattttataatatttaagggtttggacaacagtagtgataacaattctgaacagcactggctcctaattgaaaggttataggtaaatttaatgctgcaattttatattaacaccttgtccgaatgaagctcagaggaagatgccacatcccaggtcacacagtgaggaggaatggagctgtgctctgctctccacaccacctacaaatcccaggccccagcccaggttccactggcgcacggcacctagagcacagttcccaggggatgatctcagggcacctgcttcctcgggcagggcgctgccttctctcagttgtgcacttgctcctcctgcaggttctgtagtgagcacttgcattgccgtgatttatacatgttctctcccctaatatggaaaaaatatttattaaattttcaactcattttctctgatgcacactgcattagcagaaaggaataaatcacattccttatcctcccataaagccaaagattcccgaagacagagctgatgtgatgtactcataggtggatctctgcccctcaagggaggccttggtcttcaagtttcagtaattctaggaagcgaaggacacctacatctcctgctccctgctctgtagctcacctgagaacagctttctcattggaatgtcttgtgtttaaggaataagagtccatgtttcaggttcgggagcccaggtgcacctactggatgcagcccaggattggagacactttccagaagacaacatcacctgagacatgaccagtcccactgtttcactttcacaatttcaacttcctcagaagaaaattaaaattgctgagacttgttcataagtgttgtgccatgtccttactctgttttcttgcctgttcatttatgtcataccaggtgtctgttatatgtaataagatcaaaattctgcctccagtaacacatcaatggagacctttgattgtacttttggtttatgcactgacacatagattatgatgttcatcacattcatttttatgtcaaaggaaatctgcataatctgaatgccaatactttttggaatctgctaagtaactgaaattgaaaaaaaaatacccactcaagaacctggatagacagccatgtccagaatggcagttgacacttgtttaactggaagagaatctacagaagccacaagttgttgagggcacttacatgataagcactatagttgtcttaaagacagatgtggactcagtaaatgtgactgttccagagggtcttatatttctatgttttatggactttctcaccagaaacctccagattctaaaaaatactatccaaatacgtttcttatttgtcagattggagaagattaattactgaaaaatattacgggagactttttcaaaagcttctacatggaaggacttttcgagaaccttgtcctatgtaaaggaagacaaatctcccattccagatttctctcccattcttccattattatagaaatgagcaaagttagccaataggggtaagatgtaagtaaatagtccagggacactgaaaccacaaaagggagtaatggccaaagtagcttttcccctggagattcctggtcaaagtcacagcccagaagaggaagccgatcgcatctctaggtttccattgtcaaaacaggcagtgcttgcctgcactgcacaatccattctaaccagtgtgatagctctggattaaagatggaagtgtggcaatgcacagactctatgtgagaagaacactggaaaactaaaggacaaaggcagagagtaggacaaggacgacaaagcaatctgaagcctctgacatcaccatttttaagatcaaggtcttggaaactccctcattgacctttagatctctaggagaaaaaagtcagatacctgggcctagtgtcagtgtaggaggaattttctataggctaggcattaggaagaagggaaaattcttccttattaggaagttattgttatagtgttatagtgttattggaatagtggatatggagtgggctttcatctcgatcaatctgcacctgctggtattttccaatgctacattcacctgcaagagcccaatgaagaaagaaggcactcccaaatcttttgcaagtttttgtattcactgtgggtccactgcttaagtgcatctggagcttcagagaaggggctctgtcctgtgtcatagaacccttgctttgagtctcacggcagagttcaatctgtttagtaaagttgatcaattatttcaagagatggtgtcaccagcatatggtgtcactgagggagtattctacactagcacacagccatttcacgctgggctagagaagctggggggaaatgctttgtgagccccaacaggaacctccttgcaaggcaagggctgggcgggagggggcactcaggagccactcagcacgggttccagccctgcagctggtgcacaggaggctgctgagaaggtttcctctcaggggctgggtcttcctttgggagaaaaaagctaaaattcaataagttgctggtgtgcccttaaatattctatcacatctgagctgctcccacaattcaagagaaggagaactatctttttaaatattctatcacatctgagctgctcccacaattcaagacaaggagaactatctttttaaagtcggcttctaagattataaataccttaatagtgagaatatgaagaatagggatggtcttactaattcaatgcagagagaattatgggagtcactatatttccatgaataataatttcagatttcaggctggggctggtggctcatgcctgtaatcccagcactttgcgaggctgaggtgagcgggtcacgaggtcaggagctggagaccatcctggctaacaccatgaaaccctgtctctattcaaaatacaaaaaattagccaggtggggtggcatgaacctgtagtcccagctactcgggaggctgaggcaggagatttaatcctacaagacctacagcctcagacaatgctgctgtcagtgatcgtgggaagcagagtttgcagtgagctgagattgtgccactgcactccagcttgggcaacaaagcgagattccatctccaaaaaaaaaattcagatttcagtgttaagtaaagttgcctacattgtgtgagtgacagggcagtggtggatccgagagtgtggatctgagagtgagtcagaaatcagcatgtaaagatgaggatctatgcacatgaactgaaagtatgtaaacagttcatgaaattctaataaatccagtaggaaataaaacccaaacttatccaaaacacaaattcccttgaaattattatgggagcatgagttcataaagaactcctaactcctgtttcaacttctgaatcctagtgtccatgacataagaaaatcatctccaattatgcatcacagggcaaatctgtaaactaagagtttttctgttgacgatcctggggaatcaggacaccaggaaggtgctggagaaactgtctcaggagcgccccagggatctcagaggaacgtgctggcactcacgtgggacatcagcgtcacttgctcagagtcatcagtgagctgtgctggtgtctgacgggtccagcatagggccaaggcacctgctctgtgtcatggaccgagatggtccccagaatgatccaagtggtctctgtgctaatctaatgtagtttcacagtgagaggccgttctgagggggcttcttcttcagtgaaaggacctctgtccacaaatattcctaaatggacaggggcatgcatttcctcaagcaggattagggcttggaccatcagcatctcactcttgcaaggctgatgtgtcatttgtcttccctttcttatcatggatcaggctttgagctatgaaatgccctgtctcatgaatatgtaaatacctgagatccactgaggtaaatatggtctgtgccctgagagcttcacccaacaatcacatcccgcctctagagaatcccccgagagcatggctcctcaccatggacaggacctagagctaatcttcctggtggcagcagctacaggtaaggtgctcccaagtcccagtgatgagaaggggattgagtacagtcaaggaggctttcatccactcctgtgtcccaccctccaatgggtgtctgctcccaggtgcagctggggcagtctgaggctgaggtaaagaagcctggggcctcagtgaaggtctcctgcaaggcttccggatacaccttcacttgctgctccttgcactggttgcaacaggcccctggacaagggcttgaaaggatgagatggatcacactttacaatggtaacaccaactatgcaaagaagttccagggcagagtcaccattaccagggacatgtccctgaggacagcctacatagagctgagcagcctgagatctgaggactcggctgtgtattactgggcaagatacacggtgcgagaacccacatcctgagagagtcaggaaccccagggaggaggcagctgtgctggcatggaggagatgacaaagattattagattgaagactttcttagaaaatagcattaagtcatttacgaaaaggaacaatataaatgtgtatttgagaaattgtaattatttgagagatttcttatgcaacatttattctgtaagcaaattctagggattggagaattaatcaaattaataaagctgacatagaaattcctctgaaggtatctttgtaaacatcaatttctgaatcagtgttgtaaatgttttggaacacagacacaagatcacattttaactctacttttgtctctataaaaaatgccaaaaagagtctcattttgaccatgtacctctttgaattcccaccatcaatgaatgattgttcttgggtttccacattatattaccatttatcattatgagaattgtgtgttttaaccattataataggtgagtaatggtatctaatttttgcttaaatgcacatgcccctaataaaattcatatttaacaattttcatataatttttggtgagatgcctctcctgatatttggttcattttcaatagcactgttttcttttgattagttgtaagtttacttgcatattgattataaaagttaattaacaaattaaaagaattcatttaacaaatatgtgacttggaagttgcaggggtttgtcctgcacaccctgacacaatgacgaatgaataaagtgcactgacacaaagatattctgctttgccagctcgactgagcatctgggccacttagtcacagccaccgcctcgatcagtcagggagacttacatttattcagtaaagattaattgacaaaggccgtgagtaaacaccactagaaggtaattgacattgtggacctcttgagtggaaagcaattaagcacccgcggtagatcaaaggttagtcttaggaacacatgagtaaacaagctagttagataagctcctcacattcctttgtttctactctactttatgtaactaaaggtaaggggactaggctgccttcagccagatttattaccaaagttatgcaaactcacaggccttccaagagggtttgtggctattagaactaaaatgtttcccaccagcctgactggaccaccacatctccccattttttgttttctacatcaggtcttttggattggagcgtgcagatatgcgcagcaacatgtctgtcaggtgtggcagtcattgctcttattctggctttgcatcctagaattagcaaataacataaaacaatcatgagtagaattagcaacattcttttccagtcagagtgacccccaggagcggggtctaaccaggagagatgatctcacacacccttccatatgactgtttgttgggggtgtagatctattgcgtgaagagattctaaaattttagtttgaacttactttacgtctgctgttaaattgtcatgaaaggttccccagaggtattgttttacctcatcctaactatgtattgatagattccgtggtagagaagtgatacagatatgttcatgttcccagtcacagtttaaatgctgtcagaatgccactgcatcttgtcgctccctgacatattctaaagcagcctcaagggctagcagacgtgtgataattttttgatctataccttgctgtaagagaagttcattagacacatttttggccagattatctaaaaaggcagcagtttacactaagtcaataatacatgcaacagcaacactagctgttgccaggatgactatggctgagactataaaggccataagtgtaactatgaatcttttgtgtctgacctgggacagggcacgttctaaggttgcaagggcataggaaccttgccaattgcatgccagattgactggtaagaatgcctcagattttctctttaataccatggcgctagtaatttttaagttagatatactgtgattagtgatacatgaggcaaaccaagcctgtccctgcatccaggtcacaaacgtggagttttgaggtgtaatggaaatgttagttcccataaggaaatcgtatggatgggtagtgcaaattaggcactgatcagtgtgattatgaataaagcttatagcatagttgcaacgggaaatatggtatgtcccatgccaggtgttaagggaggtgctaagatgtcccagacaccataaagtaccttggggcggcatggactttacttggggccttggatatgccatccccccttggcacaaattataggggaaaagacatggctatgaaactgattgatgctctgatggatgaaggtattagtaaggctgccctgcaatcagccgctgggactccagtctaagatgttataattacctaactggaggctatgggctcgtctcccatgacagacctcccagctaaagtcgaaccgattactgtcccagctttgttccttagcacaggaaggaatgtttgggaaagaagcagcggcatggattgcattgctcagtttgaggctatctgcagctaagaatgttaaggcatttcctttgctatgatgtaaccatacttgtttttgggcaggtacacagtaagggttagagtctttataacttacacacactgggaggataatagtggattgacatatagtgttatctgccaccttagtccattgtgtgccattattgagggaccccacgtggggtaaatctatccctcctagccaagcagtcacgttactataggctgggaagggagtgtcttcccatttggcagggtgaaagaaaggtgtgtctaagatagaggcccaatagagtgtagcaggtacaggttgcagacaaagtgagagcataaaaaggattaataccctacatgagttgcaatgtacaacagaaatcatagcaccaaacacattatctggagtaaatggtgtctgcatttggagcaggattcgttcagcctcctgagttgtccttttcagtaccccccaggtaatgtctggggattgtgttgttcacagaagctgcatcgtccggggctgtaggtcttgtagggttaactccttcatttctggtactgggttgggtcctagcaatgtcctggtatggtttgatgcgtcgtgctggaacccaaagacgacccgagggggtgtggatacaagcgtaccctcttccccacattaataattcacttggaccacaccattcattactgtttacatctttccataaaactgcaggtttcatgtattgggaaattttagcaaagtgcttttctacagcggattcaaatttgtcttctaaattaaaaaaataaggtttgtgccaaaagtgttgcagggtctgtacccatactcccctgtttttgttttttgtgcatattttaagggtggagttggcaagttctactattgcttgtccttggggtttatatgggatacctgaggaatgtcggatattccacgtgtgacaaaattgttgaaattgtgagctggcctaacctggacaattatcagtcttaatttttgcgggttgttccataaatgcaaaagataaaagaagatgtttaatgacatatcgagtaaactctccaggcggagtatgtgcactacttaaatgagtgttgatatcaaaggatacatgtacctatctaagttttccaaattcagggatgtgtgtaacatctgtttgccacaacagattaggttctagggttaatacctgttgaaggaggagacgtgcctgtgagctggcgatctcagagactgtttagccagtctctgtataagttgagctggcgatctcagagactgtttagccagtctctatataagttggaattgtttagataagtttttccaattttggtggaaaaattggtgcaattgggtggcttggtcaagcagcgatatcataacttgaaggttggcttgattattgtcataagctaatggaccaggcagtgagctgtgggctggaatgtgtgtaataaaataggatgtgtactttgatttagcaattgctgaaatcagagaaaaagagtccacagggctggctccagagttgacttaattagggctgtaaaagttctctagacccaatattaaggactcaactttagctttctgagtgctagtaaacccagattgagtgaatgaattgtgtggtgtccaccagactgctgcttttccatatttaccagatctatcagtaaacagtgctaaagcattaaatatgggggagtaaactatttttgtaggtaacacattaactaggccttttgggaatgatgaaaatgggtaaattctaagggctgttagtagaatattacccataaaatgaataatcttgtagccaggaaactttttcctactagggagcaaagcttgcttttaattgctccctaactaacttaggggctttttgtaatgtctctccctttagaggttactgttttacttaaactggatttggagtcatgttaggaataagagagagataacagtggccattattagaaagaggtttctcaaattcttaaattttacttaactcttatcatagaattataatctgggatgtcgcttgtatacaaagaacataacaaattttgctttgggccgcctgcggagccagagagcggagcaggtgggtcccagggcggctgcggctttgtgcttgcttagaagccacttttcgccaccgcgtttcctctgtgccagctccctccccacactgctcagcagctgctgccggcagaggggagcttcctgcacttgctcctgcccctaatgccttttcttaacccttcgtgtacctgattgccttgctgatcttgcattactgggcagtctaagagctccccttttaatgctgcttgtcgaagacagggacatatagctgtagtgtatttcctctattttttctatctattgaaagagggggctcaggcaaaacctccgtttcctctttgttattttgggaagagcaggtggtaaggcaagtgacgtttcttcctccttcccctttttgggttcttctttgtataatgggactaaagccatccctactaaagcccatagtgttaaagatgatgctgggacccgttgcgcttgtgtgtaatgctgttcaagatttctccctacttgttcccagagctttacttctagctttccttcttctgggaccacagattatgtgagacaacagttttcattaggtgccttaattgagcctgcgaaactgatgctcccctagccttaagcaactgttacaatactttcatatgctgtttgtgttgagctgataactgctgtcccatgatgaaatctcagcctgaacaatctcccctgaacttggagatcccaagtgggcaccaatgacttactgttttactgacttgaccacgcagtcttcctcaaccttcgttttcatggggtctgtcacgctccctttgcagcgatcctcacatggggcaccggctgtgggggtctgtcctgcaggtcctgacacaacaacgggtgaataaagtacactgacacacagatattctgctttgccagcttgactgaccatccaggtagatcaaaggtgagtcttaggaccacatgagtgaacaagctagttagataaactccccacattcttttgtttctactcaaatttactaaactaaaggtaaggggactaggctgccttcagccagatttattactgaagttatgcaatctctcaagccttccacgaggacttgtggctattataactaaaatttttcccacgagcctgactgaaccccacaggaagtattttctccaagtctgtggttgccttttactcccttatcagtaggtatcgcagaaaaatgtgtgtgtttgtgtgtgtgtgtgtttgtacaaatttagattgaaaacatatataattttattcattcatagatcatgcctttggcattatatctgaagtttcattataaaataaactaatagtcattattttttccatatctctaatctcaggccacaatcaactcatgagtgtttaaacttcacctgcttgattggaggaccatcaatctaatgtatttggaatacttctgtaaggagatgtgttcttcttcctattattttttaattaatcatctattaatatcagtattggttgatggatgtccattttatactttgaaaaagatccatgctacatcattcatttaattgttcaaagcaccacagctttattaggtgctgggagctcattttgtttgaatcctgcatccttacagcacacctcatatttttgtttttgaacacttgcgtatttcctggtattaccataaattctaagcttgttttctttattacctttttttacatagaatcaaccacttttataaagattgcatgtttctgatgttaaagaatagtattaaaataaaacattgtgatactggctctgtgtgttgttaatgtggtatgagtacttctagaacctctcaaacaatggtcccagtaaacgtgcatgtttatgtgaacccaagtttatggactcattgaaactatttatgtatctaatcttctgtaaccatatcacattaaaaatgagaacacactggtctctccacccaactatgttagcacatgaacctttctagtcttctttctttgcgtttccataaccacccactgcaaagtgagaaaccccattccaccatatgtaattttattacttagctgcacagtttcaggacacatgcatagcagtatcaaaagtgtaaagctgtgcccttgatggaaccatgtttatctactagaatagagtgcttatgtgcagattttttacacattaaacttatagaatttcttcgttttctgagttgcttaggtcagcaacttcattttccacattcttcaatgaagtcatttcaattacattgtataatttcatttatttgaaattccataaatgcttagactatagtcaagtaaacagacagaggatgttccaggaatttagagagtgggtataaaataagcaaaaaaaaaaatgtggtgtttaggaaaaataaaactatttttagtgatatgcaatggttgagatatgatataactaatttgtctaagctaataattttgtgatagaaaatataaacttaaacatattcaattaaaaaaattcagcagttcattaaccccaggattaaatgcagactgtataaaattatccaataacttatttggtgagagtggggatgttatgagatacatgcaacaaagaatgaagtaattttccccatttgcatatacaatgtttccattcactgaagaccttttattttaaaaaaatcaattttctaccttacccttgtttttaattcccgacaagcaaataacccaaaggattcttttctttcattggttgagaaagattttcccctaacttcagcttagttcaggcatacgctgacctgaatgggcatttaccctcagatgggtacacacctgtcaatatgtggactcttctgtcagacagacacagcttcactcatgtggattcttccctcaaacacaaatgtccccacatggactatttcctcagactaccacatatgtccttacatttacactttcctcagaaaacagacatttcctcatgtggactcttgtctcagataagcaaacatgtctcagtgtgaatgaagtcttcactcagataagtacacatatttcaacactgactgtttcctgacacaagcacatatgtccaatgttaaactgtcttgcgacaaaatgatctcaagataatgataattataaactccaaccctgaaaatctgtagatctgcattttgtctattgtaacataacttcatctcattgtcagaaacagtcgtttgcagctataaatgcactgattacagtcagatttccattttctctggaaatgtatttcttatgttcttactggactaatttgttgataatgtttgctcacatgaagatacctgaacagtgtccacattagagaataaaaaagagcaatgggcagattaaccctgtgcatccagacgcaggaaccatttgactctgccttccctgaaatggagacacagaggatggatgagcaacgctgagtggtgcacctacgaccacaaagagaaagacctggaaatatgtcccatcccctcctcatgaaaggcagctcatcccctgttccttcaggccctggtgaggagccaccccatatctgtgtctttcttcagtgttcacactatggagtctgcactgatctgggtttcccttctcatcaccctccatattagtgtcccttgtaaatcaggtccagctgtggctgctcatagggttgttctcagtctatttcctctgtgttcatagaagtcctgtatgaagttcagtggtggagtcagaggggtaaacgtagtacagcccagtggttcactgagactttcttgcaaagcgtctggattcaccttttctggcaacagcctgaggttggtccagcaggcttcacaacagggattgtggtggctggcaacagtgagtcaacaagtgggagtgctcaggtttactcttcatgagtacaaataaattaactggtccagcgacaccctttcacgtgcactctaccttacaatgactaacctgaaagccaaggacaaggttgtgtaatactgtgagcttcacaggagagagattatctgcacaagcccagacacaaaaatctgcagggagacaggagggaactgcatggtagatgctgctcagaagcaccagggggcactcaacacaagggggcgctcaggacaccaggcggcactcaggatacagctgggggcgctcaggacaccagggggccactcaggatacagcggggggtgctcggatccaccagggggctcttagggcaccagggggcattcaggaccactagggagccctcagggccaccaggaggacctcaggacacgtcagcgtgctggagccaccgggggggggggggggggggggctctgaggaaaccaagagacgctctgaaccgcgaggggaaggaagctcaggaccacgaggggacgctcaggacaccagggggcgctcagaacaccagtgggcactcagaacaggaagaatctcttagaaagcagctccacatcaggatcctgggaggctgtggagaaatgggaacactcataaactgttgagcatttaaattagtacaaccactatagagaacagcttagagtttcctcaaaacctgacgatagagttatcatataatctggcaatcctgctgctggtatatacccctaaaaaggaaatgtttttgcactaccatgtctgtaatagcactgttaaagcactgttcacaacagtcaaaatttgaaagcaacctatgtgccgattaacacatgaatggataaataaaatatggtacatataggatatgggttaatatcatgccataaaaaaatgagattttgtcatttgcagcaacatggatgaaactggagttcactatattaattgaaatgagcccagaacagaaagacaaaattcacatgttcccatttatttgtgaaagctaaaaattaagacaattgaactcgtggagatagagagggaaaagatggtcaccagaagctgggaaggtctatggtagatggggattattggggatggtcaatgggtagaaaaagtgattagaaataataaataacacataatattttataacacaacagaataaatatagtcctcaataacttaattatagattttaaaataaaagtttatgaatggaatgttggtaactctattaatgcttgagaggatgtataaaatattcttcatgatgtgattattatgcagttcatgctgattcagagtcctgtaccccataaatatatacgtgtactatttacccacaaagattcaaaattaaagtgtttatgtgtctaatattctgtaactatattacattaaacctaagaacacactggcttttacacactactgtcatccacatagacattcatagccttctttctctgcttgtccataatcccacactccaaaatgagaaaacctctcctaagatatgacattaatttacttagtgcacaatttcaaaatacacaaatcgtctttaggattgttaaactgacccttgttgaaaatatgtttatcaactagaatacagtgcttatgtggagcttatttatgttttacaatcgcaacatcaaattctttccaagtctcttgtgtccaatatttatgccccaccttcttcagtgtaattagttcaaaccttctgattgttgttagatatttttatacagctgtctttttttgtgtttcatgacctgctaaatactttcgaagttgtatgcatttaggttaacactttgtctcaaaaaatatgagttttcagaaattctttatgccatgtgtccatcattgaatatcataaaaatagtttcattggccgggcgtgttggctcacgcctgtaatcccagcactttgggaggccgaggtgggcggatcacgaggtcaggagatcgagaccatcctggctaacacaatgaaaccccatctctactaaaaatacaaaaattagccgggagtggtggtgggcacctgtagtcccaactactcgggaggctgaggcaggagaatggcgcgaacccgggaggcagagcttgctatgagcagagatcgcgccactgcactccagcctgggtgacagagcaaggctccctctcaaaaaaaaaaaatagtttcattgggattaaaaagtgtgtgtttcacctaatccacacaccttctccccaccttcctgggaaacctcaaatgtttactggatctatatttttatctttggcaaaacagcctggctgttctcttagcctcttttgcaaagcatcaagattcaccttcactgactacagcataaattgagcccagatggctgggggacagaggctggagtgggtggtaacagtgattgattcaagtggaagttctcagtgatattctgcatcagcataatgaagattcacaattcccagggacaccaattaccagcacagtctcccttaaaataatctacttggaagctgagggggctctcacaggggtaggcagtgtattactgtgagagacacagcgagggacatttctgtgagtccagacagaaacctccctgcagggagacaagagaggactttgtgataaatggtgcttaggacaccagggggcactcaggacagcagagggtgctcagcagagcagggtgcgctcaggacatggtgtgtgttgtagggggcattgctcaggatcaccagggggctctcagaaccaccaagggtcactcaggaaaccagggggcgctctggacaccagggggagctcagaaccaccaggtggtactcaggacaccagggggcgctcatgaccagcagggcatgcttgggactctatgaggcatgcaggagaagcaggccatgctcagggcaacagggggctcacagaaccacctgggggtgctcagaaccactaggggtcactcaggacagcagcaggcattcgggacaccatggggccctcaggacctgcagggggcgctcagaacaccaggggaaggtcagaaagacctgggggcacttggaaccaccagggggcactcaggacagcagggggcgctcaggaccactagggggcgctcaggaccagcagggggtgctcaggacaccatggggcatgcaggagcagcaggctgttctcagggtaacagggggctctcagaacaacctgggggtgctcagaaccaccagggggcacccaggacatcatgcggccctcagaacctgcagggggcgctcaggacaccaggggaagctcagaatgacctgggggcactcagaaccaccaggtggcactcaggacagcagggggcgctcagtaccacggggtgcactcaggacagcagggggcgctcaagacacagtgggatgctcaggaccagcaagaggcactcaggaccaccagggggcactcgggggagcaggaggcactcaggacaccagaagaggatcagaaccactcgggggcactcagaaccaccagggggcgctcaggacactgggggcattcagaaccaccagcaggttctcaggacacccagggacactcaggacagcaggggcgctcaggacaccagggagggtgctcaggacaccagggggctctcagaaacacctgggggtgaccaggactagcaggggcatgcaggacaccagggaaggggctcaggacaccagggggtgctcaggacagcagggggcacagaatcacgagggtgcattccagaccaccaagaaatactcaggaccaggggtaacagaaacacctaaagacacacaagaccaccaggaggcactcacgactgctcagagtgctgaggacaccagagcttcaggacgaacagggggtgctcaggccaccatggggggctcaggaaccaccagggtatcactcagacaacagggttctcttaggaggcagctccacatcaggtgcctggggagggtcagatttgcttttagaccttgctgatccctgatctggtcaagcgaaaaccttcccaggatctctcaccatttcttccttgtaacccatggtttctttcacgtacaaatcattaacttagaacaggaattcaattcaacttttaaccctccatatttttagaataacactagcagtaattgaatgttttgataataagaaattgcgtatgcctaattcaagctctggttccatgcatgggtttttgttttctttgctgtgtcagtcacactatagtcaatgcttttctaccaataactcagcataggcatagtgttaagtttctttttctttcatctgccttttgtggagatgaaacaccactttcagggctcagttcccccaccttggttgggttctggtgttctgctcctcacactatttctccaccttcccttcttctgtccaagccttttgtcttcctcagtctcctagcaaggaagcaacaagtccctttattttgcctcttccatgtctggtgaatctgttcacttctcttcatgatcattgaagtcaaccaagtttaggaggataacagttctccttagaatatgctcatctacctgcagactctctgccttcctcacccctttctagggtcctgcagacgtcacctccaccacatccactcctttacctaagtaccacagaatagtctctgcagctcctgctgctctctgtgtgctcagcactaaggctcactagtgctttgatgatgaagttcaaatccctaatgtgttagcaattctcagacaaccctgccattgtgagtgaattttggggatcctgggctgttttcagttccatattactggatgttctctagcatccaggagtactggcaaattaacatctagaatttgtattgcaaatttatacaaaatcaattgtagaaaaaaatcctaatttctaaataagaacatttatcctgacttttataaaaatacaatgtgaatttaaccaataatataatacaattttaaaagtgatgtttatcttatatgttattaagtttattaataattggctggtattttaaaagtatactgatagcaaaactgacaaataaaccaacacagattctatacataaataccattgtccatttaattaatgtgtttggccagaatggcatttacattcagttctaccgaggcatgtctttaaatgtatttgtttattggcattaggatagagaaacactcacacagaaaagcattatttgggactactacattatactataaaagagagtaaattcaattcaattaaataaataaaataaattgaataaattcatgttttggtttggtatttggataggtgttcatttttctattttcacatgtatatttcagtactgggcatatgtgtgtatgtgtatgcatgattatgaacttctaaaatacattactcccctatatagttatataaattgaagttttgcatgttaagagacagtagaaaccacaaaaggggaaaagttatagaaagcatttggaatacctagggcctacagaggagtcatattaaaatgaaaaataatagctgaatattttggaaatgacacatgcagtaagaaatgtctatatgaaattaacaggatattggcacaaaatttagaaaaaaataacatgattatgcccactattggtctatgatatgcctataataataacacattttatttatcatagaaaataaaataattatacaaatagcactctcattgcttgattttagtattaggtacttcacttgttttttgatagaaatgaacatttatcattttttgatgataatttctatattatcttctaaaattaatgtccataattatgattgacatgttataatttccagaaacctattttatcaattgtgacttgtatttttatgatagtatttttacattcatatacatttgattcagaataattgtagattaacaaaataatcataaagttaatacagtgtgttcccatctctaagtatctcctaagatgaacatcctccacaatcataaaacatggtgttaacacatttacgttgataactttaaatatattcaataccaggccttatttgagatttaccatttttccaataatttcttttgtaaaccaaaaataaaattctaagcttcctcatccaactaaatgaactcaactatcagccaaagatattttaaagtaaactttaaaacttgttccagcaataatgggaaaatgagaggtcagatatgcctcattatgtcctcctgtctttggaattaaggcacctgtggccagcattaacactaaaacaaagacccttagactgacaaaactatattttttctataaacactcttcatagtgaaaagataccaaattacaatatgattctagtatagcatcacatgacaaacagcaacgcctaaaaatctattctctatgaagtctgctacctggaggtttcatctacataataacaattatgagctccacaatctcgtatcttaatccagatactcatttgtaatgagtgtgtaacatttcaaccaattgccaatcagaaaatgtttgaattcacgtatgtcctggaagcacttgagtaagcttattctgcctttctggactgtgtaaatggtatagctcacatgtgttgattcatatctgtctataccttctgtaccactaaaatgtataaaatcaagctgtaaccaaaccattttggatacgtgtactcaggaactcctggagttgtgtcatgggccttggccactcatatatatctcagaataaactgtcttaaataattcacggtttgtctcttttagtggatactgtctttttcttttttctttctttttttttttttgttttttgagacaggatctctccttgctgttgtttttgtatatttgtttgttcccagattccaacaaggtcatcactttgaattgagttgtcatgttcctttattctcttctggcaaatcacagtttgtgtttctgaagttttctagtttaatattttatagataaaaatttatcaagtagattgatagtcctatttaggacacttatatctttacttatttgaacactgcttgtcaatcacaatgagtgttgatttctccgtcttctatacatgttattatattttctgttccaaatccattcattaagtatttttaaatgtattttggaaagttgatcctattactttatgtaatatttctcttgagtcccaaaggtcttctttttatgattattttgtcttaaattaacatagctatttaagttttcttttggtttatattttcatgatatatatttttccatctttattttttctatttctgaatatgtaaagaaattttcttggagataaataatagttgggtgtttttttttagtcaactatgaagaattattttttaatgatgttactcttttgtccaattattcttgttttaatttgtatttttacaataaagtttattgtttctattaacttattatttaatcattctgtgactaacattttatgggttaccataaggataacaataaaaagtttctataattgaattctaattcaaaaatttaattcccattcatatatactacagagatattataactctatatatctaattcctctttcctatcccatgttttttattttctgtttgtatctatacatgctataaaatgtaatattggcatttttataattgctttccacacttacataatgaacaaaatacaaatgcaaaaactgtatttcaacctcatttttccattgttgaccatcttctttgtgcatattttcaggtgttggatctatgtcacatggctattcatctagagactctgctaaaatgtctacggaaagattcatgtgctggaaataggttttctcaggttttattggtccgacagaatatttatttgtctttgatttattgtctccagagacaatgtcaagaatatgctatatctgcaaatgggcgatctgtaaaccaagaacacatcagtatatcactgtgcaagaggagcacatgagggaaagccagtgtgtgcccagacataaacctccagggacacatgggcgaattagctgcagggggagcttgggacccactgatgagagtcgaccccagagggaggtgcacagaaaggttaagaactgctttcctgccagtatatttttaaaaaaacaaaacttccatctgacagtttctccagagaacttccctaattttagcattctgtgcctaccaatgccatcactaaataggtttttaaaaaatattgtaatatgaggacatattctcatatggacaaaacgcaaattgacatttacagaaatgaaaagtcctcaaccgtggtcgctagaattggagacctgtagcagctcagtgggacctgttgagtcttctccaatcacactcagaacagagaccttagtgcatctccctgactagaataccctttaggtatcgagataacagcctaaagatggtaaatcatgagagtctcagatgtccagatgacagacatgggtctatgggaatagtactgtaactgacagtaactaattttccataccgccagatgtcctattcaggagcagctacagcagtcatgcctaggtgtgaagatcacacactgacctcacccatgctgtctctggccacttcatcacaaccaatgcttaatattggacgtggatctgccagtccccggggaatgggttgaatggataaaatgcatggctagtgctgctggaaacccattcctactgtggcaaatggcagcatctcttttaaaaggctaaataatattctattctgtatacataccacattgccattatcctttttgtttgtttgtttgtttgtttgtttgagatggagattcactcactctgtcacccaggctggagtgcagtggcgtgatttcaggtcactgtaatccctgccttctgggctcaaacaattctcctgcttcagcctccggagtatctgggattacaggcatgcaccaccactcccggttaatttttgtattttttgtagagatggtgtttcaacatgtttgtcaggctggtctcaaactgtgacctcaaaaaatcaacccacctcagtctttgaaagtgctcagattgcaggcgtgagccatagcatccagccacttttctgcatttttttttcattgacacttagattatttcaatatcttggctcttgtgaatagcgctgcagtaaacataggagtgcagatatctccacaaggtggtgattttttctatcttgggtatattcccagaagggaggttgctggtcatacagtagttctagttctaattgatttaagatcatcttactgctttccatagtggtggagattcagattagtgtagctattatgaaaaacagtttcaatgttggggagtgactgaaaaacaaataatgcttgattatggttctccatgagagtctctaataaacctaatggaagttcagaaagtttcctcaccttgttaagaaaacatttgttttgctcataattctctttcagcccagagttggcagtatgtagaatggaggctgttggctcgtttaaggattctgaagcaaagaacagtaatgagagatgacaatagagaaaaagagagagaaggagatgctgaatcatcatggactcattccacctgcaagcctttcactgtaaagctctattgctaaggatcctgaggattctatactcccatgaatgcataatcaggatccctcaattcaaattttattggcagagacacactgggacccctctaggatatgtgccctacattactggctcaacatgccgcactgagaatcctgcattaactggctttatttgtagtggtgagtaaagttcacagttttcagtcatccatgaaggggagattttttttttggttcatataatttttgcagaaattcaggtattagtgaaaaccaataagattgaggatttctggatattttagcaacactagggatgatggccattttgtagaaaaatttacatttttcaaactgacctacatgttaggctgacataaaaaaatccaactacacagcaatattatggcaacacttcaatacacttggtggtgaaatacctcagaaatgaaatgttacacagattaattgagttaatgaaactgttctgaactatgataaacatttgtttgcacccagatttgcttgaattcaatttgattattatattcagctgctgccctaacttatttgaatgagtaagttactatttaaatgaccctgtctgtttgatttgttatatatacatctgaattaaagaacttaaaggacaggtttgtgctattattagaaagagatattctggggggcccttgtttgctccaggaacctccacatttttaacttagaattaatataaattccttgtgaattgggtcagtcttcaagagacctaatctctaaaacatatacccagaaccttctccagacagaccatccagaggaagaatctttccagtaatttatctccatggtggaaggtccttcattgtcatgcagaaccctctgcccaggcttcctttattatgcaaataattaatattagccagtagggtaagattaaacaaaaatagaccggagatgctgcagacagggaaggaagtaatagaccaaaatcagctttattaatggagactgcttttaaaggtcacagccaagaaatggaagaggataaaatcaatgagatgaaattgtaagaaactttgtccagttcaatcaagccatcagcaaccagatagcttcagtggacattatgtgtattacaacatggctaaagattctagattacacaaggattttctctatagtttgcatattgacaaagtggaagatggcatgggagatctggtggcaaacacttaaggtgcaataatagctatttttcctatatcatgacaatacatggcatgcctctatattcatttcattccaaagaagtccttcagaaggtcaagtaaatggagaatcttacatgcatggcccaatgcagtctccaagaagtgattttgaatgtacagctacaccagttactgcaatgctgtgtctgaccttcccagcatctaagatattcatgagtatcaagggggagatgggtctaggtgaaagaaaaggaagtagtcattcttgagaagaatggtatggccaagataagcctgaactctctatcttcttccatttgctgcagcttcttattgcccgattgaggtcactcgcccatggtggtaatgacatcagcaatgcagtacattctctggtggctttgtatctggtttataatgtgggagatgtttcctcaagagtggtgacgccagtatggcttctgctctctggtggtgatggcatctgcattagcctaggggtttggagaaagagagttattcagaccatggggaagaatctgacactgtcacaccgcctggtgccttcagtactggactggctcctgccctcattggtgattgcatcaaatattggcctcctcatcagtacaacacattgtaacagtcttctttgtacctggctttaatccaagaaagttgttgacttatggctctttcattatattgtatggcctggtttgtcacaatctttatttctggaattatcagtgctgccatcttggctgacttcaagtatgtcatcctcacagtttgaagctgcttgacattaacatttttgtcaatgtttgggactaccttacatattccggctctctgaaagaatgattagcgttagggaaggctgacactaaatttgggagccagagaaggaaagtgttactgtgctacagttgttttgtgataaatatggttaggttaaaaatgagctatgtaatgtagccaggtttccactgagttccactttgcttcttggctgtctattcctgtgcaagtttctatatattttgtatcaggcttcaattccattatgttttaaatgttgtctctaaagataaacaaagattttttaaaactaccaaacatgcagccatttgacagagtgtgcgctgcatttttagtctcaccatcttctgccctaacaagcaccgaatctaacaacacaaatatcatggaagctttccttggagtagctcctgtaattagaatcattggtattctgccctcctgtcagtggtggaacgttctattggcacatgtggaaacctcttagagggatgagtttctttgaacacaataaaattttaagttaggaataacttatttgaaagcaattcattgaaggttattgctaagaagaagttagaagcagtcttttggcagtcatttcttcaagatgtatggcagcgtaggatggatatatgaagtggaataggaacttgggctagttaaatggaatagcctccaatgttaatctgtttaccttttaactgaatgaaaaagcctatagttgtaagaaaagaaaaaacaatacagtgctcccctgtcccacacattaccttctcatcagtataattaatctacattgaagatgagtgtggtaatgcagagactctatttagggaggagaacatagggaaatgcaaagacaatgggagaaaaaagtcaaggacagtagagcaattcgaagcctctgataccaatagcttgaggaccaaggtcatgactcaacttttggtggacacagagtcacttctcttagggaaactgcagtattctaaggtgacaatatgcaaacatgatgaatgtacacttgctacatctccaattgtgtactgttttccttacttctgtttgaagaagggagtcgtatactcaggtctagtatcagtgtagggggtgctccctatttgcaagatactagaaaaaaatggtaagttagaggcccattgttataaaaatctactagctccgtgtcagtgtgtgtgtgtgtgtctgtgtgaatgtgtgtgttattgaaacagaagacatggagtgggcattgatccacaagcatagatacctacaggcactcttagatgtaatatttaactgcaggagtctaaataaaataaaggattcgccaaaagtcttgaaaattttggtgctgactatgtgtccactgattcaatgcatcctgagttccagggaagggaatccccaattctttcatagagttgactgggtctcctaaggtcaatgttttcaaacgatggtgtcagtaacatatggtgtcactgaaagagcattttaaactagggcatggccacttcctatagccctagagacactgagaggtaaatgccctgtgagcccagatggaaacctccatgcagggcagaggcagtgctgcagggggcgcccaggacccacccagaacaggctccagccccagagctggtgcacaggaggctgcagagggagtctctcacaaggactgagtgttactttactgaaaaccaaaaaattataacatgctaaataagaattttatgaggactatttatgtatatttaaataccctaatgtatttagaaataaataaatcaataattcagtgagaaccacatttaaaaggcaaaattattactgctttgagatattttactagtaaaaagataaagaacaagaatggttttattaaataaaaatgtacacatttcagagacacactggtcccgagagtaagactgcggagagcaaatcctggaaagggcggaggctgtccatgtgccatgggaacttgggctcacgctgagaaccatgtccggtgtgagtcagcttcttagcggagaaattctcccttcacaaatttccgggcatataaagggaaacatgtcattaaataagaatgaagatttgtacctcagcatcccacagttgtgtggtccatgtgagatctattttctctttctcgtgctggatcaggtgtaatgctatgaagtagtagtcctcatgaatacgcaaatcacctgaggtgaacactacagataactctgtgccctgagagcatcacccaataaccacatccctcctctagagaagcccctgagagcacagctcctcaccatggagtggacttggaggatcctaattttggtggtcgtagctgcaggtaggataattctcagtccccaggactaaggtgactgggtccagtcaaagggggttttatccactcccgtgtcctctccacaggtgcccagtcccaggtgcagctggtgcagtctggggatgagatgaagaaggctggggcatcagtgaaagtctcctgcaagacttgtggatacacctaccttcaccagttactctatgcactaggtgcgccaggcccatgcacaagggcttgagtggatgggaaggatgtgccctagtgatggcagcataagctacgcagagaagttccagggcagagtcaccatgaccagggacacatccacgagcacagcctacatggagctgagcagcctgagatctgaagacacggccatgtattactgtgggagagacacagtgtgaaaactcatatcctgagagtgtcagtaaccctgagggaggaagcagctgtcccagttttcaggatatgacaggatttatggggtttaatgttgtttagaaaataggttatataattgaggaaaagaagaaatagaaagatatatgcattctaattatataagaaatattcttttcaaatctcaccctataagcaaaattaacagagtgggaaaagcagcaatcaatcaagctgaaacaaacattcccatggaggatttgtgggggcagacgttttaaaattgaatgggtaaatcatttagggcaagattgcttgatccaatactaagactaaatgtaatttctgagaaactgcctatctttttatattaaatttattataaagcagttttagggttacagcagatgtaaaaagtagaaacagagagctcccatgtacccctgcccaacacatacacagccctccccatgatcagctccctgaaacagagtcctaactgcgttatgtgggatgaacctacatggacacactagttctttcctttcctggtggtcccccggtataacaaacataaattattttgaagcgccacgggttcttcaagtgggttactgggaatgatgccagttagagggaaagtgggtggggccattcctttttgcactctttcttcaggaatccataaaatgcacattgacttagagctcatctgactcctggttttctatgccccttcccagagggtaagttctccaagcgtgggaggaaggtccatttcactaaaaggccagaagcttctggtgaattccataatgcacaaccttttttgagaagtggagactttggacatgagggatttcatgtatgatgccctggagttggattaaatacagcataagctcttgggggtatttctggaggaggccctttctgcaggaaattagaatacatgcaggggatccaggcaggaagaatcacttcctttgacatcgtttggcacctgaaggaagccctctcagcattgggcactggtcccacttgctggctgcactttagccagaggcctgcgcctgatcattcttgcagtgggagagccttactggggtcacaggttataaaaatgcctgtcactctccagctgagcaagtccatatgcgtgcttgtcagtgtcaaccccatgatgagtgcactctggaaggtgacaatctgcacacaaacctcctcccactagttacccactactatacactactttaaaaattaatacttataattatataatataatatatattatataactatataaaaatgattatgatgatgacatttggctgttgcaatttctttaggatctctgcatctctcttcactagacatgtaagtcttcaatttcttgtccctgtgacacgttgcccagtgtttgaagtcaaagttgtgccgagtacctgagtatgtcctcagagaagatctcagcaatggttgattgttctacagggacttttccaggagacctgtcccagggagtcatgaggttcctctggaaatactagcccctgcaggagatgagacggaagcaggagaatcaagagcaggtgacaacattgtcagcaggaggctccagatgctttccagacacagtgaaccttcacccacttgccacactgcacagggagtttgcaggggcacaatgaggtgcctgtctgtgggatgttgggggacaaagtgaaaacctgagctcagcatccaggaaagtatgaactccagccctgataatatgtagcctgtgttttctttccttctacgtgaacactttgccttattgttaagaacagaggattctagctctaagtgcacggattgcagacagctatgactttcctccgggccaggctcctcttaatgtacttcttggacttatttgttgatgaaggttggttccattaaataccaaaacagggttcatattaaagaaaaatgaaagagtgacaggtagattaaacccgagcatccagttccagtgattctttgaccctgccttcccaaaaatctccgatatgaacaatgacaatgccctccatggttagattatattataaactagattgagctagagtgtttggtgtattaagtcactattttttttagcttccctgttagttttttgtttgtgtgttagcatttactttaaaattctattaatcagttctctagtaggtagaaattcatctgagagtttcttctcttgttgtccactttgataagatttccagaagacataagaaccctttttgtttgcaaaaatattccaaagttttacactaactaggaacatatatacttaattctaatttttaatttgtttaaaagctctaataagtgcactgttttctgccttttgagttaatttcacaacacataggagaatatatcctaaatgaaagtttgtgctaataatacaaattattggtaaataacctctgttttaattattgaggtattatccattaatatataatcttaaattgatgttctcaatgggactcttacctaaagaatatacaaaatattttcctgatcttgacataaaatagatgtgaacacattcttagtattcagccatgtctcctgtctatcacattatgaaccacatgctaactttgatttacttgggacttgttctaatttcaaactagttatttttttatcttcatgcagctggattattatgtgtggctattttatcagagaatgataaagacaattttaacaattttcactgcaggcacgtctaggcaagccccctgtgcacaatgaccttcgtgggttggacattctatggggactctcccctgtctgcctaggagagttatctgcctcctccctctatcattttcctctttgaataagcgcatctaactgccgttagaatacagacaaaggccaaccttaactgctcccagctgacaggggatgctgttttgggaagatctcccttgaggtctgtctaagggacctagtaaaagggagccattatcccaggcttcacttggatgaccatttggagttgatgcctgaaggtgagaagagacaaaccaggttattagaagacatgtatcaaaaccaaacaaggtggtaaggacagtttgaaaaaaaattccaaggctgctgacacacccagataactggcggctgtagttatgcctgctaagatttgggtgcatggggcttggctttcgttagctccctaggacttattttcccaaacaaagaaacctccgggttagggggaccctatttattccagtcacctggcatgatttgcaggataattgctcagaattaaaatattcgtccagatgtttatatagcccatgcctgtgtttcttctgagctgcagccagagatcattggttcgttcacagcgataagcagagttagtctaaaatggaggcaaatacttaaaacaattggaagagactgtaatttaaagacaaatgtatgatatgttttgaaacataatttttctctctccagttctgatttttgtcagaaactaatcattataggactgagtgatttgcaaaataaactttagtcttgtggttggtctgatcatttgcataaagtggagcaataataattaataataattctgtaggaaaagcctgcaagcaccaggagcttcacagtctaacagtatgagcacatgcatcctccagcaactcactgaatattttcaagtcagctggttcttagcttaaataacatccagttggtatctgtcccaggaacactaatatatggttctctctgcaggcccctctcgccacagatttaaggtttatttttttcctctgtgatatcaactcagatatgttgaaggtttttcccacatttgtggtttttcaggtttgttgttaataaggtcagaataagatcatagtttactcatttttttacattcccatgctgagtagctacttttctctataaaatccattagctgagagaaaaaataacattttcctaacggtgaacaattaaatagtttgacatatatttgtgtaccagtatataatgcagcttcgaatcaaggtgtgcctcaatcataaaaaacatggctaaattctcaaagaattgtgctgagtgaaagaagctaaggaattaagagtaaattttatataattcattgtagaaatattagaagatgccactaccataaattaaaatgaagaagacttaaatttttctgagaaaatggtgttgggaatgatgcggatgtgatttaagtttcagaggaataaggaaaaagatttagggattaatttaattattcaaaagttgattgaagtgccgagtgaatggctgcaaacatagctctacatttttcaaatcattccctataaatctgaattaattatttatttattatacttgaataaagcaataacgaagaaataaatgaatatttttgctaaaatggagcaataaaaagactgatattgacagaagaaatatgactgacttctgaaaacacacatgaaccatggttctctctgcatatttaggtgaattacagaaagttgtcataacagatggggaatcctgcagacttcactaggcatggtccacgctgccctggagttgtctcaggggagctgcctcctccggtgattagagcacaggcccagataataggattacatttttttagatgtgtaaacttagacgcactgcacagctgctgtattctctatgtaaattatcttctgtaaaatacaacattaaaggctgcattaaatatattgtgtaaatatgtaaaaataaaatcagattatgagagctaaatgttaatcaaggcacaatcacataatataaaattatattttcctgaatgatggaattactaccaatctcccccaggagacttcatctgcactgggcccggcctctcctcagatgtcccatcacagagcttgctatataatgggggacatgcaaatagggccctccctctgctgatgaaaaccagcccagccctgaccctgcagctctgggagaggagcccagcactgggattccgaggtgtttccattcagtgatctgcactgaacacagaggactcgccatggagtttgggctgagctgggttttccttgttgctattttaaaaggtgattcatggagaactagagatattgagtgtgagtgaacacgagtgagagaaacagtggatatgtgtggcagtttctaaccaatgtctctgtgtttgcaggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgagagacacagtgaggggaggccattgtgcgcccagacacaaacctccctgcaggaacgttgggggaatcagcggcagggggcgctcaggagccactgatcagagtcagccccggaggcaggtgcaggtggaggctgtttcctgtcaggatgtgggacttcatcttcttccaacagtttctctaatgaacctctctaattttagaattctgtggttcctaatgtcatctctacatattttcaaaagatcattttaacatgaggacataacctctcatgcaccaaatgcacattgatgcttacaaagatgaaaagttctcaaccattgtgaccaggatcgcagtcctgaggaagctcacgggtgtctgatgagtctcctccattcaggcccaggacagaaacctcagagggattcctggaccagaacggcagggattctgatcacagccaatagagaggctgggccagggtcagtgtcctgtagaagctcacagggttcaagtctgacccttctcctgaccctaaagccaatgagcatcagcactgatctggtgctgcttttgctcccaatacatgttctttctttggagtgtttgttctcccttttttatttgcttttctttcttcctgaaaaagaaacacatggtctctgtgatctacactccagggctcaaggcattttcttagaactcaggcaaggctcaggcttggctactccagccacgtgggagaggctgacgggatttccttctctctccatattctcagggccctcctctgtgttgtgtgtagactcatctgggaatgcaattggctgttagtagtgaaggggatgaactcatttgatcaaaatgggatgtggatgtggaattaaccctgttctatgcacactgtcagagtcatcttcttcagaagtagtgttagaaagagcttgtgaaatttatcggcaacaaaatggatccccttgtgttaaaaccctaatgaatgaagctggggaaggccatgaaggagggttctaacacatattcctgataagatgaactgtcataaatagactctgcacagccacaaccttttacacggagaccaccacagccttaaaagctttatttctccaagtaaatctgccctgcaactgcctgttcaaccttacaccgctgtctcaaaatagctgctgtcaccctcctcatttttccttaattctcttttttattattttttaaattatactttaagttctagggtacatgtgctcaaagtgcaggtttgttacatatgtatacatgtgccatgttggtttgctgcccccattaactcatcatttacattaggtatttctcctaatgctatccctcccccttcccgccaccccatgacaggccccggtgtgtgatgtttcccaccctgtgtccacatgttctccttaattttttatcttccttttcctacctgaatgtacccatacatattttaattgaaatgcacatcctggaaaaaatattattatactttagagtctctttctgtctgttattcaggttgacaagctgcagacggacatgccacatttctgtgagacatagaggatgacagtttttggagatgtctaggaatctccaatgtccataagatcagccatcaataaatgcagactggaggtcccagagagaagtgaagctgctgaatcgccgtggaatttcattttctccagttctgctctgatggaatcaggcccaccaattttatcaatgacaatctacctaacttagagtcaattgataacagtattaatatcatctattaagtaaattcataactatatatatagtaagagagggagagagagagacagagtctcgctctgttacccagggtggagtgcaatgtcatgatcttggctcactgcaacctctgtctccggagttcaagcagttctcctgtctcagcctcctcccagtatctggaaatacaggcacacaccaccatatccggctaatttttgtatttttagtagagacagtgtttcaccacattggtcaggctggtctcaaactactgacctcaggtgatccacccgcctcagcctcccaaagtgctgggattacaggtgcaggccaccaagtccggctaatttttgtatttttagtagagatggggtttcacaatattggtctggctggtctcaaactcatgatctcagcctcccaaagtgctgggattacagatgtgagctactgtgcccggccaacatcacctatattaatgttggattgaataactacaaagtctaccctaaccaagtgtaccatcaaacttaccattacccagagggaagaatctttaacatgagatcgatttcttaagtgttttaaggtgcaaaactgaccactgtacaatcacccaattatgattttgctaatgagttgtagaagttgcatgtacattttggatattaacactttttcagatgcacagcttataattatattctctctttctgtgggttggaaattttttccatgctttgcagcatctttttgctgtgatgtagttctgcttgttcaattctgcttttattgtctgtgcctttaatttgaaatataggaaatcattcttaatattattttctgggtgggggaaattttacaattgcaagccatacgtttaagtatttcgcccatttagagtaaattttggtatttaatctaaactaaaattcttaattctttgcatgtgtagattcagtttttctaacaccctcttagggagagactttgattcatccattgtatattgttagttctcatgctgaaaatcagtttgctgtagatatattagtttatttctgagctctctctatatattaatgccaataccatcctgttattatttatggatcaaaatgtgcatatttgtgaatttcaaaatgttgttcagaacttgtgcatgccaacaactgtgtttctcctgcactcttgggctagtgaagctctcacagaccctctctctcacctgtgctgtctctgcattctccatcacaaccagtgcttcctgctggagctgcatccatcaccccccgcaaggaagggactggagcgaatcaggtgcacaggtcatgagggagtgcacattccaacccactcctcaagagtccagtcactatctccagatccacatccaaaaaacagtgtttcctgtagctgagctacctgagcaacaagtacacaaccatgaattttaatacaaaagacacaacgaggggaagtcattgtgagcccagatacaaacctccctgcaggggagctcagaaagagcaggaggcactcaggacaccagggaacactctggacacatcaaggcaggtgcaatggggggacaaggggctggagatggggtttggcatcaccatcgtatttcaccactggacacccaccaccgtgtttattctcatgtacctgattctgtgtattattagaaaatggcatttatataaatatatagccatatgtaggtgcatcaagttgtcctctccatcgtatgtggacctttccactaagactctgagtccctgtatttatatgagcacctcataaattatggtcaattttgtgggatctctatcttttctttctcccttcttccctccttctctctcactcacaaactcacacacacgcaaaattctacaacttcagttacgtgatgtgttgaagacagtttataatgtgcagcttttccagtttagctgatgttcatattgctgtgagaataggaacattgtgtttctcagctgtgtatttctctaaggtagcagcaacttttttttttaatttgacattttttaaaaattttattattattatactttaagttttagggtacatgtgcacaaagtgcaggtttgttacatatatatacatgtgccatgttggtgtgctgcacccattaactcgtcatttagcattaggtatatctcctaatgcatttttttaaatacccagatactgaaagcaatccaaatatcaatcagcagcttaatcataaacaaattgtggtaaattcattccctggaaaatcacccactgttacattctggtaccgctggatacgttcaacagcaaaggtaaagtcacaagtacatatgatgagtcaaataagacaaataaatacaagtacacacatacaattcctcttttataaattctataaaattaataccaatctaaagttacataaagaaaaccagtagttgactctgggtgtggtgtgagaaggaaaggtgtaggaacaagaaattacaggaaaacaagaggaaattttgagggcacttgagttttttctgtgttgagaaaggtaatggttatgtcactatttgtcaaattgtgcacattatgggatggctattatttgctaatttcacctcattaaaatatgccaaatttaaacacatataatttggtagaaaataagttagacagagatgaataaaatatatgagaaataaaaaaagaaaatcacagaacgttggcataaggacttcactcatcaaactgaagaaattttaaatttctcaacacagaattaaagatttaattaaagatatatgagaaatcaaagactcctggatatatacatgaataaaccctaagcctacctatatttttagggaaacactagaatacaacaaaataatgtcatgaattcattacataatgggcgttaatcaaaccccaccaggcatgtccagctgtgtcctggggttgattcagggaacaggtgtgtcctgtggttaggagaagtggcaacaagctcacagcatctgttctagttgacaccataaaaaggccaagagatcacaaccaaaatgtagtgtggatgtcacatctgtgagtgccgcacactcccccatgtgaatacgaaaaggttgattacctcttgaggtgtctgctgagagtagagctggtctctcaggaatgtccaaaatggctcgatagagcaagaaaggagactggctcaggttgctataccagtttggtggtggaggcagagtgagggttctcactcacagaaatgggtttgtggggtttgaacctccaaatggcatcaaatgagggagttcttgtgattcctaactagatccacctcgtgtcggaaagaaaggagatgatggaggaatgagccttaagttatcagcagtcagacatcaaaacaagtctgatgacttattctatgtagcaactataaataaatgaataaaaatagatcataatgaattattcataataaatgaataaaaatatgaataaaaatagatcagtgtccaatatgggtggacaaaaaccagtctacacaaaacaagaagactgcttataagaataagcaaatcataatgaaaaggaggaaaatgaggtgaaaggcacggggcaggggattacacaagggtcctgttccaatgtcttgtgtggagacttttcattacctaaaatcatccgcttgttctgaatgtcttaggtgagctgtctgctccaaaacatcagaagcgccagaggattcatgaggatattcagtttaatatcttctatttaaggtgccttacaatagtgtaaaattcttaattattattattataataagagatagggtctcactgtgtcacacaggttggagtgcagtggcacaaccatagctcactgtaaccttgaacctctggctcacacaatccttctttataagcctcctgagtagtgaggacatgagaccaagctgatttttttttaattctttcatagaagtggggtctctctatgttatccaggctggtcttgactactagtcttatgtgattcccctggttttgcttctcaaagtggtagaattatagacatgagccacgatattcggtctgaactgattctttagttgcaaaatatcaacccaagaattgactcccttaatttttttctgcagtgttttggttaatattgcctgataaaatttattctaatttgtttcaacagcagaattcttcctgacgttttttccaatatatgtattttcatggttgaagatcacaaaatactgttaaaacatgacataaaaaggcaaccttaaacttttggtgattggagttagtataatacaaaaattacgtccaatattgtgtaacacacacatgcaaaaagacgaaggtgagcaatgagggtaaactttctaaatgtatgaatcttccagctcccaagtcataggatagtaactgatgtggcctgagggaggtaccagagtgacacagtgctagtggcataactcttggccaagagactttcaatattttattaaagtttttatatttttttaatttaatgatgccatttttttcaacatattcagaatattgtgagtgggattgattctggatgatatgaacaatgggaatgccttctatgtttagataatattaaggaccaggttgagattgaaagtttgtagaaatgatgcaccataacattattctagtttccatactaggttttttctctttgcttgcatttcatttcaaatttatatgtcagatatctagaatgtaataatttatttaaaaatttcttttcttgtagtccattttgatggggcttccagaagatttgaaaacctcttctgcctgcaggacattttaaaattctgcactacagtaaaacatctgtatttaatcatggtcttcggtttattgacaagctctagtaagtgcaataacttctgccttctcggctgattttacatcagatagaggaatttatcttaaatgaaagtttgtactagcaatataaattatgagttaataaccaccacctttattatttaggtgttattcatcaagaaataatgttaaatcaaggctctcaacgggaatattatctaagggatgcacaaaatgttttgctaatctagataaaatagatgtgaacacactcttagtatccagtcatgtctcctgtctgtcacattattaaccacacggtaactttgacttcacttcggactcgttctaattttcaaattcgttacatattaagcttaatgtctctagactattctagcagagtgaagaaagacaagctagactgacaaacaacctaggatgacaaacttcttgtcactctctataagaacttgcttctccctgaacttcagacttgtcgcgtgttttgaaacattaattatcaaaagtattaaagaaaatttgcaaagctacatcttctatgtttatgttattgttgatgcaattgtaaaaaataaggaaaatgtattccttttctatgtgcgtttccaaacttaatagcagatttttagtaagacccagaataataaaaaattcaaatattgttcagctgcttaacagaaaaacaaattatggtaaatttgtttgctagaatgctatccagtatttagaataaataaatgtctgctatacccaactataaggtaaaatatcgaattacatatgttaagtaaaataagccaaacaaataagaatatatactgcattgatttgtataaattttaataaactaaatgactcagccgcaatgtatagctcaggagttgccagagaaatggtagaagaatgaaagggaaaaggaggaagaatgtagaagaacaaaaggaaatgttgagaattctcttgtccaccttgataacaatgatggttacattatatttatcaattgtacaatttaaatatgtgaaagtttattatctgtaaactaaaactctcaaaatttattacaagcaaacaaatggaaacttagacaaagaaggagtgatagaaagatagaaaaaatgtatattaaatttcagaaatacctaagaacttatctgcctgaaccctagttctcaccatatttttaggtgaatgctagaatgcagcaaaatcacacgtgttctcactacagaaagtgggttccacaaccacactaggcacgcccagctctgtcctggagttggctcagggagtaattggggccagtgatgaggagcacaggctcaggtactggggcttactcatccagacgtgagctcttagacacatacttagccctttctccatgcgtggttgacttccacatctgtacatggagaaacaattgactccgacaaaacataatttgcacaaatatgtaaaaataaaataggatgatgaattcaaaaagtttatcacagcataattttataataagacagcatattttctgagtaccatcgttgtcaccaaattcttgcagggcacagtcattttatctgggtactgccttctcgtcaggcttcccaccccagagcttgctatatagtaggagacatgcaaatagggccatctctctgctgaagaaaaccagcccagccctgactctgcagctctgggagaggggccccagccctgggatgcccaggtgtttccacttggtgatcagcactgaacaccgactaccaaccatatgaagtctgggctgagccggtttttccttgttgctattttaaaagataattaatggtgaactagagatacttagtgtgaggggacatgagtgagagaaacagtggatagtgtggcagtttctgatcacgatgtctctggaggtgtccagtgtgaggtgcagctggtggagtctgggggaggcttggtacagcctggggggtccctgagactctcctgtgcagcctctggattcaccttccgttaactactgcatgcagtggatctgccgggctccaggaaaggggctggagtgggtaggtttcactaaaaacaaaactaatcgtggaacaacagaatacgccgcgtctgtgaaaggcagattcaccatctcaagcgatgattccaaaagcatcgcctatctgcaaatgaacagcctgaaaaccgaggacacggccgtgtattactataccagagacacagtgaggggaggtcagtgtgagcccagacacaaacctccctgcaggggcgcgcggggccaccgggggcggtcaaaacccactgaggacaggacaggtcccaggagcagatgctggggtagttttcctttctcatcagctggagaagtcaggtttgtatttgcaggactctgcagcattctaggctgtgacattttatcacttgtatttattatgactttattatcgttagtatttaaattttagtaattattaaaattatatataagtacattttaaatatgtactttgaagatataaatattcctaattatttgcactgattcttccagagttttattaacatttgttgacatcagcaactacatagctatagggacataaatttataaacatagaaatatgtatcggcaagacatggtggtctgtgcctgtaaccccagcttgggaagctgaggcagaagtactgcttgaacccagaaggcggaggttgcaatgagccgtgatcgcaccactgcactccagccgggcaactgagactccatctcaaaaaactaaataaataaaaagaaagaaagaaaaaaagatgtacaaatacacagacctatgcatatatgtgtaggcattcatattaaacattaagataaaataattctaaaaacatgtcctgaagaatcaaaattaatgatgaactaaatataaattattagagtaattcataattgattttggttatttttaattgtttacatgttgtgattttacacaaaatattagtcatttatcctgataaaacaggtcaaaatgttatatcaagagtttatttactttgtattactaataatataaaatgttccacatatttttagccatgttttacttatctgtgaaatgtgtttattaatttttcattttaatatgtcacctttatctttctaatttcctggatttaattccactacagctgaatgcattttaataattattgtaatcacatttacattttttatttgaattttcatatatattttattaggattttaatatcaatataaatattttcctaccattgtctattttctatttttatgatataaaattaacataaaaatgcttagattttcaatgtacagcttgagggcttctgacaaatgtgcgcacaaataagaattatttgcttactttttagtgtatactgaggagtgggattgctgggtaaaatgatatctctgttttaagttctttaagaaatctccagtctgctttccaaaggggcaagattaacttatattcttctcatcagggtataagtgttctcttttctccagagtcccaccagcattcattgttttttgactttttcgtgatagccattctgagtggtgtgttgctgcacacctacaatcatctcatatttgataaggctgatgaaaacaagcaataaggaagggactccctgttcaataaatggtgctgggacaactggctagccatgtgatgaagattgaagctggacgtctactttcaacatacataaaattaactcaaaattgatgaaagacttaaatgtaagacctcaaaccataaaaatccttgaagacaacctaggaaatactcttctcgaccccaactttgacgaataatttttggctgagtatccaaaagcaaattcaaccaaaacacaaatagatgagtgggacctaattaactaaggagtttctgcacagcaaacccgccaggagatagatgctcaggacaccagagagaactcagttaaaccagggggcgctcagaacagcagagtgtgctcaggacaccagggggcgctcagaaccaccagcaggagctcagaacagcagagtgtgctcaggacaccagggggcgctcagaaccaccagcaggagctcagaacagcagagtgtgctcaggacaccagggggcgctcagaaccaccagcgggcgctcagaacagcagagtgtgctcaggacaccagggggcgctcagaaccaccagtgggcgctcagaacagcagagtgtgctcaggacaccagggggcgctcagaaccaccagcgggcgctcagaacagcagagtgtgctcaggacaccagggggcgctcagaaccaccagcgggcgctcagaaccaccagggggcgctcaggacggcaggggtcgctcagacaccacggttcccttaggaggcagctccacattaggtccctgggcagggtggggtttcctttttgaacttgctattttttgaccttgtaaagcaaaggtcttccccaggatctcttagtatttcttccttgtaactcatgtcttgtcttgttttgtttttgtttttgttttttgtttttggtcatctacaaaaacttaaacttagaacagttgattcagaaaggcaggaaagcaggcattcctctaagtctcccctgagacaaatacatatatgatttcttcctccccactataatttatgtaaaaatgaagattcactgagtcagactaaattgtgtattcagtggaaggataataaatgacacaaaagaatgcaacctattgtctcttatcttcttctaacctgcaagcccccattttcatttgtcctggcttacaggaaaaaaaaatgtacatttcacatgtattgactgatgtctcatgtctctgtaaaatgtataaaagcaagctgtacttcaatcaccttgtgcacatgtctcaggacttcctgaggctggttatggttgggttcttaactttggcaaaacaaatgtattagtctgttctcctgctgctgataaaaacataatcaagactgggtaacgtataaaggaaagagttttaattgactcacatttccacgtggctggggacacttcgcaatcatgtcagaaaaggaagggacatcttacatggtggaagactagagagagcttgtgcagatgaattcccctttagaaaaccatcagatctaatgaaacttattcactatcatgagttcatcatgggaaagacctgcccctatgattcaattacttctcactgggttcttccaatgacacatgggaaatgtgggactacaattcaaaatgagttttggatggggacacagacaaaccatattaataaacttcctaaattgactgagacctgtctcagatatttgttgtttatcctactcatgtacagccttcagagttccaaagcctatatcagttttccaggattgtttcccctttttgttggttatttcctcctttattttctatgtttagttccctttttctcccactattttttcatcattgggatgtgagacttcacaacatttgaaaggtaggtaacaatgagctatcttaacaacatgggacctgtttatctaagagtaatccattctatcaatgaaagataaaacaaaacaggagaccagaaactcatttggttgtaaaatgcttcctctgaatgattttgaaaaggaacaggtggggaaaatataaaaggaaaataaaaacttgtgctgtcaattcattatgtcatgaggggggaaaatcctaaaggatgatccatgcaagaaactgattttcctttcattcctaagagaatagctacaaataaaaagttaaatatcttcacagatagctactctttgttcattttactttatataaagtgctaacttagttcaggagaactacataatttttctgtttccctatgtgcttctctctcattacaacatgtaaattttcatactgtccctctttcccctctatccagctttccccccttttttgtattgaaagccctgaaaatcatctttggggaacggcactgaccacaaatttttctgtgattacttgtattttcattccaggcatgccctaactttggcaaaattaattttaatttgattgagatctgtctcggaaacctttggtttacactaggaaagatcccaaattacgagtcaattactataaagctcagccttcccactgtgtatgtgtgtgtgcatgtgtgtgtgtgtgtgtgtacacgtgtgttttaatttttgtgggctttgagccatgtagttctctctgtggacatactatttggcgtgatctttgaatagagaattctgaaagaaataagaggctcctatgagttctctgaaagtttctggactcaccatggatcttgactgtgtcattgcatctgacagtcccagggaacagactctctggtggtttcaaagaatctgtgcttgggctccccctgcagtttactgggtacagtaatgttaaatcactgtttcgagagacaatttcgaaagcattagatgctgctgagagaggattgtgaaccaggggacagccccttcattctgggggagcgacattgggagaatatgctctgtgagcccaaacagcatcctcccctgccgggtgagggcagagctgcaggacaggcccagaaaccactcaacacagatgtcagccctggagcagctgcagaggagtctgaggagaaaattttaccagcatctgaattacacttatttcaaaacaaaaatgcaattaaaaagttaaaataagtaattaatgtccaggcacagtggcttacacctataatcccagaaatttgggaggctgaggtgggaagatttccaggagtttgagatcagtctgtgaaacatagtgaggcttcatctttacttttgaaaataaaataaaataaaacataaataatttagcaaaaactaccgatgtgtcttccatatcccatcgtacttagagcattgatgtaacccaatgagtcaatgagaaccaaatttgaaaggagaaaattttagagttttcagatatcttaagagttggaagatgtagaacaaaactaattttatcaattcaatgtgtgcaaacatggagagacacactcatgccagtagttcaacttgcaaagggcaaaaaccaaaaaagtttgaagttgctagtgatccatttgtaggtgagatcattttgaggatcatgtcctgtgagaggctgtttctctattagaggagttctgtgctcatgaagtgctggacatgctaggggacaaatatcagtaaacaaacatcagaacttgaatgtcagcttccccctgctgcattctccgtgtgtcatctctctgttatttctcatgctagatcaggtctttagctatgaaatattccacctaatttacatgtcaatagcttgaagtctactgagtttaattcatattttttctatatgttacagttacagtttgtccacaaggacaaggtttgtccacaagtttgtccacaaggttacagtttgtccacaaggactcaatcatagaagtgcagagtccttttcgggccacatttaattcactttatcagtgcccttcagtatgtggttcctgagaatttcacatgacaacacatttaccacactggaatttaagcaatccaacacatgtttgtagctttatcttgtaataggctgtatttcatatggcagcctctgcttcagtttagctaacactatggctttgtttctctctacaagaacttgtttctcccaagatttccatgtttgtgaaaggaaaagaaatctctgggacccccaaatcactaagccaaagggaaaagtcaagctgaaaactgcttggggcaaacccacctccattctttccctaaaatgatagctactaactgtcaggcctctgagcccaagataagccatcatatcccctgtgacctgcacatacacatccagatggccggttcctgccttaatggatgacattccaccacaaaagaagtgaaaatggcctattcctgccttaactgatgatactatcttgtgaaattccttctcctggctcatcctggctcaaaagctcccctactgagcaccttgtgaccccctctcctgcccgccagagaacaacccccctttttcctttacctacccaaatcctataaaacggccccacccctatctcccttcgctgactctcttttcagactcagcccgcctgcccccaggtgaaataaacagctttattgctcacacaaagcctgtttggtggtctcttcacatggacacgagtgaaactaaggttttaaaaaactacatacctccttcaaaatttgaccacaaggaaaaaccttgtggaccaacaacagacagagtcatttctctgctcacataagtcaaatgcctatctgattgccaccatttctctattgttttgctaagccagactaaggcctacgtgactattcctgtaaattgtgcattcagttaaaggctaatcagaaactcaagagaatgcaagcatttgtctcaaacctacctgtgatctggacgctctctccccacttcagaaagtcctgcctttctgaaccaaaccaatgtacatcttacatatattgattactgtcccatgtctccctaaattgcataaaatcaagctgtgtcccaccaccttgggcatatatcgtcaggactccctgaggcggtgtcactgccatgtccttaatcttggaatacgaacttcctaaatctattgagattagtctcaggtactctttggattacaggtttgttttttatttcataacttcaattatctgaaatactaaacaaaatttgccaaagtgtacattctcttgttgctgttgttgcaaaaaatatatttatgtaacttatatataatttatcatctatgtgtgttaccaagctgagtagcagatttattagtaagacttagagagagtaatgaaaaattcaaatgccagttagtaacttaatagaaaaacaaattatgctacatttgtttgctgaaatgctacccattatttgtaagaaataaacacatgcaacataaaagatttaattctcagtatttctattgagagaaataatccacatacataagagcatatactatattttttcattcttataaattctagaatataaaagctagtcaaaagacatgtgaaaacatcagtagatttataaagaaatggtagaagaagggaaggagaaaaaccaaaaaaatataaaagagcaagaggaatgctgaggggagttgacttgtcaccttcttaaaaatagagattttatttttcaaagtttactattgtacagaataaatatgtgaattttcttatctgtcaattaaacctcataaaatttattacaaaaaaactgaaattttagacaaaaagagggtgataggaaggaacaaataaatatgttaaatgtcaaatatacctaaaaatttatttgtctgacccctagttttctccgtatttttaggtaaatgcagcaaaatcacacaagttgtcgtggcaggaagtggattctgcaaaccacactaggcccgtttatctctgtcctagagttggttaaaagagcaactgaggccagctgtgaggagcataggcccgggtactaggactcactcatgccagatataagcccttagacacatacatagcccctccatgtgtgggttcacttttacatctgtacatgaagaaaccactgattcctaaataacataatttatacacataggtaaaaataattaaaaatgtgatagttattaagtgtttatcacacaacaatttcacaataaaacagcattttcccaaatgtaatcattgtcatcgaaatccccaaggacactctcatctgccctgggccctgccctctcctcaggcatctcaccccagagcttgctatatagtaggagacatgcaaataggtccctccctctcctgatgaaaaccagcccagccctgactccgcagctctgggagaggagcccccgccctgggattcccaggtgttttcatttggtgatcagcactgaacacagaagagtcatgatggagtttgggctgagctgggttttccttgttgctatttttaaaggtgattcatgaggaaatagagatattgagtgtgagtggacatgagtgagagaaacagtggatttgtgtggcagtttctgaccttggtgtctctgtgtttgcaggtgtccagtgtgaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagacacagtgaggagaagttaatgtgggaccatgcagaaacctccctgcgggaacgctggggaaagtcatctgcagggggcgctcaggagccactgatcagagtcagccccagcggcaggtgcagatgaaggctgatttcctgtcacgatgtgggacttcatcttcttaaagtttctctactgaacctaagttcggaattctgtgattactagggtcatttctacatatttttaaaatgattgttttaatatgaaaacctattctcctatgcagaaaatgcagattgatcctcacagaggagatgaaaagttctcaaccatggtcaccactgtcagagtcctgaggaagctcagggcttcctggtgagtcttctccagtcagactgaggacaggaactccagaaagaatcctgactagaactgaggtattgctcctcacaagagaactcaagctgcggggggtctgttcctgcagacccctgacccggtggcggatgaataaaacgtacactgacacacagatattctgttttgccagttcagctgagggtccgaggcaacttacagactccaagaagaatcctgtaaagaacggcagcagtggccctgagcagctcgcactccaggcgtgtattgagtatagaattaacaacagaagctctgacaacacacttgtggataattaacatggttaagagagtagttctacgaatgattaaagctcagggactgcggtctaaagtaaataccattagggggcaataccctggttagttaatggaggtagggtaaccagacttaactggggagccctctattgtccctagtatttaccctatgcctaacgctctaaggtaagagctgcccaccttcagcctgttcaattattacaagctatgtaacctttcggccttctagagaggtatatgactattccctataactttccttaatattcccctttaatatttccgccaccatcctgagtgaatcccagcaaggacagtctttggggattctgattacagaaaaaagagagcctgggccagggtcagtgtcatgtagaacctcacaggtttctcgtaggacccttctcctgacactgaagaatgcaaatcagaatcaatactgatctggagcttcttttcctaattcatttactgtcttttttagatgttgttctcatttttccatttgcttttcctgctttccgaaaaaggaagatgtttttgctgtggtcaaaattccagacctcaagcccttttcttggcgctcaggtgggtctcaggctgtggctgctgcagtcacgcaggagagtctggtgggactttcttcactcttcgtcactcaggaccctccactgtgttgcatggagactcatctggaaatgcaagttgccagtgggaactgaagggacaagcttgtctggttaatgtgggatgtggatgtgtttctaatcctgttctgaaaaaccgtcacacagtaacgttcttcactagtggagaaggaagtgggtgtgaacgttgtcagaataaaaatggagccacgtgtgttataatctttacaggcgaagctggaagaggtcatgaatagagggttctcatgcacacatccctgataacaagaattaccctaaaaatactctgcacaaccacaatcttgaacaaaggctaccacaacaataagagaattaatactgaggggatatctgccctgcaactccctgttcagccttaaactgattctacccttgttattgattcttctaccccaggataattgtctcaaaatagctcaggtaatcttctcatttatccttcagacacttgtctttctttaccaacctaaatgtgaccatggataatcccattgcaatgctcattttcaaataaatacgatttgattttggagaatctctttctctctgatgtttaggtttgacaagctgcagagggacacaccactttcctgtgagatgtaggggatgacagttttgggggatggctggaaacgtgcagtatccttagggtcagccatcagtaaatgcaggctggaaatcttagaaagatctcaagctgcttaatcaccacggagttttaccttctccagatctgttctgatggaatcagggccaagtttgttattgatgataatctacctaatattgagtcaactgatcacagttttaataacatctatttaaaaattcacacctggattagtgtttgatcaaataactacaaagtattgcccaaccaagcataccatcaggcagactgttacccacagagaaaaacattgaacatgagtttgaggttctcacattgttaaaggtgtaaaaccgattatgtttaaattatgctatttttattattgttattgagttgtagatgtttcatttacattttggatattaacgctttttcagattcatggcatattatccaattctgtgagttggaattattttgttactttgcggaatctttttttaaatctagtcccacttgtccaattctgtgtttttttatttgtttgaatgtaaaatccagaaaaagattgctaattttttgagggttgagagttttacaattgcacgtgtttcatttaagtatttaatgcatttagaattaatttttttgtttattctaacctaaaattcttaattctttgcatgtaaatatccaattttcataacacgctctttggaagacactataatttagcaattatatattgatggttctcacgctgaaagtcagctggccatcaatatgtgggtttatatctaagctctctgtatgaatttatgcgaatgccattctgatttattactgtatgtttctaataaatgttgaggcctggaagtgtaatacctcaagctttattcttgccttgttacagatattagaccaaaatattctaaaattttactattgagtataataatagctgtggcttttgttaattggtttcattatgtacaagtagttttcttgtcttcctactttgttcagagtttttataatgaaatcctgaatttttttcaagtgttttctgtgtctgatgaaatgttactgagatattttttctttagttttttaattaatcaactgaattgattgatttgagaatgtcaaatcatctgtgcatctcagaataaatttgagttgatcatggtgtatggtcttctataaaatctttagaatttattttactattgttggggggttaatttatgtctactaatgatattggtctatgattttcttttattgtggtgcctttgtctattactggtagtactctaacggtagcctcatagaaagagtttggaaggtgtgttgcagactacctttaaaatagattttatcagtggagaaacggtgatagtttttttcttcagttttctgttgggaagagttttgtttgtttgtttgttttttgtttttttgttttgttttgtttgttttttgagacagaatctcgctctgttgcccaggctggagtgcagtggcagaatctcggctcactgcaagctccgcctcctgggttcatgccattctcctgcctcagcccccaagtagctgggactacaggcgcctgccaccacgcctggctaactttttgtatttttagtagagatggggtttcaccgtgttagccagaatggtctcgatctcctgacctcgtgatccgcccgcctcggcctcccaagggaagagttttatgttgtttaaaagatattctgaataacttaacctgcttaatgggcttacataatattcctttcttccattctttttaaagaactgcttacctttcctaattatttttagggtgatttttcacataaagattgtgcaatacattttgaggtgagacttagtggattttctctaatgaattagaaataataaatcacttaattgactattgtattaaggttgatttgttgaatatttgctaaaggccagttctttaagctgtgccatgtactaaatccctaaccgactattttattcaggttggtttgttgaatatttgttagagaccagttctttacactatggcatgtaataaattccaaatggcagtacgtcattgtttacttagcttttgtgcttatatttttcagaggaaaaaaaatactgtaaattgtaaatacccaatacctaacagtattgtatgcaaatctgtgactgttggcagtgtcatctctgagaaacagataaagtttatttactatatataaaaaaagagtttggaaggtggactcctcaccaatttttgaaagagttagagaagcattagcattaattctttaaatgttaagactaattttatgatgtaacatataacctatcatggagaatgttcaatgggtgcttgagaaggatgtgtattacatggctcttggttggaaggttctgtaaatgtctttcaggtaaatttgttcaatactgttgttcaagttcagaggcttattaagaattttctttctggatttgcaatacattattgctaagtgaggtattaaggttttcccttatttttatatagttttctatttctctctatatatatatcttaaagtttgcttaatgcatttatatttgtatttgtactgtgtaaaaagtaaaataaaataataattgcttagtgagtttcatggcacaatcacgttatgaataatcatattttcccaaatgctgtcattgccactaactcctccagatacatggtatattatccaattctgtgagttggaattatttcgttgctttgcagaatctttttttgttaatctagttccacttgttcaattatgctcctccgggagtctcacatctgctctgggcactgccttcttctcaggcatcccacactggagcttgctatagaggaggaggcatgaaaacagggccctccctctactggtgaaaacaagcccagacctggccctgcagctctgggagaagagccacagccctgggattcccaggggtttccatgtggtaatcagggctgaacacagagctcactatggggtttgagctaaccagaatttttcttgttgctattttaaaaggtgactcatagagaaatagagtgagtgagagtgagtggatataagtgagaaaaacagtagatgtgtttggcagtttctgaccaggacgtttgtgtattttcaggtgttcagtgtgaggtggagctgatagagtccatagagggcctgagacaacttgggaagttcctgagactctcctgtgtagcctctggattcaccttcagtagctactgaatgagctgggtcaatgagactctagggaaggggctggagggagtaatagatgtaaaatatgatggaagtcagatataccatgcagactctgtgaagggcagattcaccatctccaaagacaatgctaagaactcaccgtatctccaaacgaacagtctgagagctgaggacatgaccatgcatggctgtacataaggttccaagtgaggaaacatcggtgtgagtccagacacaaaatttcctgcagaaagaagaaaggattctgggccgaaggggacactcagcactcacaaaacaggtggagccccagggcaggtacagaaaagcagtcaagggctgctgtccttcaggatctgtgctttcctctgcatgtagcagttcccctcgaatcctctgcacttttatgtttctgtgcccaccatgaggtccctggattacaaaactttaatttaaaagaggaaacattcttatatgtcccaaaaacaaaagtaagtattagaggcacaaaagtgcacaggcggccaggtgaggctgtagacactgccaccccgcaatgccagtctcacaactagcactggagagtagtgggcattcagtggagcttcctacctatcctgtggtccgagctaagtccagcaaggccattggtgccttccagagcacagtagtccatcaggaatctcccatgtgtcccagcagcagccttgcctcagtatctccactgtgcacagccattgtctgggagggagctcccaggatgagtgtctttggcacacaccaggtggcgggtgttagagtgcagtacagcagctggctgcctggtctattgggctccctgatgttggagggatttgaggtgcattctcaggcccagcaccctctttgtgaatttttatataaaaaccctgattttacttcattttctcagatgacatagataactaaaaacagaatctgcaaagaaattgtaattttcaactttaccccaaattcattgtttcttaattctgtgcaagatccaaacatatttttggcttccacatgagaaattgttctgtttaaactgaaatcatttcttctcatattctttcttttgggccaagtacagagatcttgttgaaaataagttgggttctttccacacactaaccctcacctcccctagagaaagagcagagattgtcctcactctgagtctaggggaggagctgttcctgtacaattcagagcctgcagagaccccccccccccgccaggtgcagcttcagtgagtcagacatttctccatgtgggcgacctccagtgcctgtgactgcttctcaggcctaattgtgggttaagaattaggacactctttaagttatcacatctgaatcctattctgaaaatcaccataaagagagatagttcaatggctattctcctgacataagtttctctttattacttggttccaagtatggagaaacatgtgacccaatatttgtctgaatccaacatcagaatcccctgcatttctctgggaaactcccggatcgaacacaggtgagctctttattctcacagaaatgtatgtagttgggaatttcaacaaattgtccagaacctgtgcctgccaacaactgtgtttctcggtgcactcttggcctggtgaagcccccaaagaccctctccctcatgtgtgtcatctctgcattctccatcacaaccagtgcttcctcctggatctgcatccatcaccccctctctgggagggaatggagtggattgggtccatagatgatgaagggagcacacattactcccctttcctcaagagtccagtcaccatccccagatccatgtccaaaaacagttcttcctacagctgagctacatgagcaacaatcacatagccatatatttttcagcaatagacacagtgagggaatacacagtgtgaactcacaccaaaacctccctgtggggatgcataggacagaaggggttgctcaggtccccagggggctctcaggacaccaagggtcactcaagaccattgtagaggcacgcaggtagccgggggctctcaggaaccatgggggaaaatcaggacaccaaagggtgcttggtacagcagggggctcaggacaattgtggggattcagaaagaacagcttcaaggctcagcttcagggcaggtgcagctggtgtgaaaaggggctggatgaggcgttttgtgtcaccatcatgaaacaccaccagacaccctccactacatctgttctaatgcatgtgtttgtatgattaggaaatgatattgatataaatatataaccatagctaggtgtgtctttttctgccttccgtcctcccttcttctctctctctcacacagaaatttacatacacccaccccacaacacacataaatctataacttttattacctgatgtattcaataaacctgattaatgtgttttgcagcttcattgtttatggtgttgtagcaataaaaaccatctgtttcccagctgtgtacttctctaagctgagtagcatctttgttcataatacccagaatgaaaaacaacccaaatgtcaatcatcagcttaactggtaaacacattgtggaaaagtcattcattgacatactacccactactaccatcagctaatgttggctatgctccaaagcatggttaaattcacaagtacttcagatgagtaaaatgagccaaagtgataaaagtgcatacataggatacaactttcataggttctatagaaccaaaagtaatctaaagttgccaaaaaaaaatcagtagttcactgtgaatattgtaggagaagggatggtctaggaaggaggaattatggaacaagataaaatgttgagggaattgacttgttatctatgttgatagtgataatgtctatgacaatatttgcccaattgtacacttcatgtggagattattgtttttagtttagccccattaaagatagtattaattagaacaggtataaattggtatcacaggaattaaagataaataaaatacatgtaaagtcagagaatcctgaatatacacatgaatgagcactggacatctctgtatttttagagaagcactagaatacagcaaaataatggcacaattttacatcactaagaaagtttatcaaacccaccaggcatgttgtattagttcattttcacactggtataaaaaactacttgagactgggtagtttacaaggaaaagaggtatagttggctcacagttctgcatggctggggaggccacaggaaacttacaatcatggtggaaggtgaagaggaagcaaggcacgtctcacagcccagcaggagagagatagaggaggggaagtgacacatacttttaaatcatcagcggttgttagaactcactcactatcatgagaacaacatggggaaactgcccccatgatccaatcacctctcacctggtccctcccttgacatgtggggattagaatttgagatgatatttaggtggggcagaaaaccaatctatatcacatgtccagttctgtcctggagttgtttcagggatccagtgtgtcctgttgatagaaacagtgacaccaagttcatattatcagttgtagttgacaccatgcaaagccaagagatctcaagtgagatttagtgtgtatgttgtgtctaatgaagtcacacactcagagcaagtgaatagggaaaagttcattatctacactgtagaggtgtctgctgagtgcagggcaggtctcccaggaaaatctaaaatggcttgaaagaaaaccaaaggagactggctcagggtttttataatggtttagtggtgggggcaaagtgaagcttcccactcacagatgggggtttatagggtttgaaactcccactggcatcaaatgaagaagctcctgtgagtctgaactagattcatcttgtgtggcaaaaaaggagacgatggaggagtgagccttaagtaatcagcagtcatgcaccaaaagatagagtgacaacttattccatgcagcaggaataaaaataatgaataagaaagaagacaagggttcagtatgggtggacaacacccagatctgcagaaatgagatgactttagaaatgtaagcaaagaataatgagaaaaagaagaagtggatggaaaattaaacaggggcctggtctaatgtcttgggtagaagcttttcacaatcaaggactatcagcttattctgcaggtcttaggtcagccatctgcttaaaaacatcagaaacgccagagggtctatgaggatgctcagtttaacatctcctatttgagtagctttacagttgtgtggaattcttaattgattcttttttgtttgtttttagggacaggctctcacactgttccacagcttaaagtacagttgtgtgatcatagctcaccttaaatttgagctcctgactcacacaacctttccatcttagctttctgagtatctacaactagatgggcacaccacccctaccctccttattttttaaacattttttcatagaaatagcatctctttatgttgctcaggttggcttcgattgcctggtctcataggatttccctcactttgcttctggaagtggtgtgattatagggaagatccactgcatctgacctgaatttattctttagttgtaaaatatgaagccaataattaactgcctgaatgttttctgcagtgagttagttaaaagcatctgataaggttccttcctatgtgattcacgagcagtattttccgctgatgttccttccagtttccttgctgaagatcacagggaattgtggaaaatatgtagcaaaaaggcagccttaaactcttcattgttagagtggatatcacacaggaatcactttcagtattttgtaacacatgcatgcaatagagcaaacatgatctctgggggtaaagtctataaacgtatgggccttttagctaccaagtcatagggtaataactgatgtaccctgaggactggaccatgattccatagtgctagtggaagaacccttgaccaagggagttttacattttattaaaatatgtagagatgccactttttaaacattcccagaaggttgtgagtgggattgactctgtctcgtatgaacaaagacaatgccctccatgattagataatattataaactagattgagctacagtgtttgctgtattgaatcactgtatattttattttttagctccatgttagttttgtgtctgcgtgttagcgttggctttaaaatgatattaatcagctctgtagtaagtagaaattcatctgagagtttctttccttgttttccagtttgataggatttccagaatacataagaaccctctctgtttgtaaaaatattccaggccaggccagtggctcatgcctgtaaacccagcactttgggaggccgaggtgggggggatcatttcaggtcaggagtttgagaccagcctggccaacatggtgaaacctcctttctactaaaaatacaaaaattagccgggcatggtggtgcttgaggattgcttgaaccctggaggctgatgttgcagtgagccgaaattgtgccactgcactccagcctgagagacacagcgagagtccatctcaaaataaaagaaaacaaaacattccaaagttatgcacaatctagaaacatatgtacttaattctcatttttaatttattaaaaagctctaataagttcaatgttttctgccttctcagttgatttcacaacacatataataatatatcctaaataaaagtttgttctcttaatacaaattactagttaataacccttactttattattgaggtattatccatcagtgttcatcaatgctctcaatgggactcttacatagagaatatacaaaatattttcctgatcatgacataaaacagatgtgaacacattcttagtattcagccatgtctcctatcatgttataaaccacatgctaactttgactttattggaacttgttctaatttcaaactagttattttttatcttcatgcagctggattattatgtgtggttatttattccgagagtgataaagacaacattaacaattttcactgcaggcatgtctaggcaaccccctgtgcacaatgaccttggtgcattggagattctatggggactcttccctacctgcctaggagagttctctgccttctacctctatcattttcctctttgaagaaatacatctaactgtcgttagaatagagacaaagacaaatcttaactgcttccagctgacgggggatgctgtttggggaagatctctcttggaggcctgtctaagggaccccaggaaaagggagccattatcccaggcttcagttgcatgagcatttggagtttgatggtctgaaaacgagaaaaggcaaatcagattattagaagacatgtatccaaacctaacaaggtggtcaaggtggtaaggacagtttgaaagaaaattccaaggctgctgacatgcccagataactgcggctgtagttatgcctgctaaggtttgggcgcatgaggcttggcttttgtcagctccctgggatttattttcccaaacaaagaaacctccaggttaggggcaccctattcattcccatcacctggcatgatttaaaggataattgcttagaattaaaatattgatacagatttttttatattccccatcgctttttgtttcttctgggctgtagccagagatcattgattggcgctcaggaataagcagtcagtctaaaatgcaggcaaatacttaaacaactgaagagattagaatttaaagatgatcgtatgatatgttttgaaatacaatttttctctttccagttctggtttttgtcagaatcaagtaattgtaagactgagttgtttgcaaaataaactttagtcttaaacttggcctgattatttgcataaagtgcagcaagaatattaataataattctgtaggaaaagcctgcaagcaccaggagtttcacagtctaacactatgagcacgtgcatcctcacgcaactcgctgaatatttccaagccagcctgttcctatcttaaatgccatccagttgtatctgccccaggtacactaatatatgggtcctgcttctctgcagcctcctctctcctcagatttcaggttttgtttattgtttgttttctctctgatataaactcaaatatgttgaaggtttttttgtgtgtggttgttcaggtttgttgttaatgagatcagaataagataatactttactctttttatttatttatttatttattttttgagtcggagtctcgctctgtcacccagactggagtgcagtggccctatctcagctcactgcaagctccgcctcccgggttcacgccattctcctgcctcagcctccagagtagctgggactacaggcgcccgccaccatgcccggctaattttttgtagttttagtagagacggggtttcaccgtgttagccaggatggtctcgatctcctgaccttgtgatccgcccgcctcggcctcccaaagtgctgggattacaggcgtgagcctccgcgcccggcccatactttgctccgttttatattcccatgctttagtagctgcttttctctatcaaatccattaactgagagaacaaatcacatttagttacaggtgaacaattaaatagtttggcatatatttatgtactggaacataacgcagcttgaaatcaaggcatgcctcactcatataaacaacatggctaaattctcaagtaattctgtttagtgaaagaaactaaggagttaagagtaaattttatatgatacatttgtaggaattttagaagatgccattattgtaaattaacacggagaagatttgagtttgtctgacaatacgctgttgggagtaatgtggatgtgagttgaatttcagagaaataaaagaaagatttagggattaatttaattattcaaaacttgattgaagtgctgagcaaatggctgcaaacataggtcaacatttttcaaatccttcactataaatttgaattaattacttattaattacacttgaataaagcaataacgaagaaaccaataaaataacatttgactaaaatggagcaataaacagatcgatgttaacacaaggaatatgactgacttatgaaaacatgcacatgaaccatggttcactctacgtattttggtaaattacagaaagttgtcataacagatggggaatcctgcagacttcactaggcatggtccacgctgccctggagttgtctcaggggagctgcctcctccagtggttagagcacaggcccaggtaataggactaatttttttagatgtgtaattttagacacactgcacaactgctgtgttctctgtgtaaattatctcctgtaaaatgtaacattgaaacctgcattaaacatattgtataaatatgtaagaataaaataagattatgagagctaaatattaatcaaggcacaagcacataatataaaattatattttcctgaatgatacaattattccaatctgtcccaggacacttcatctgccctgagcccagcctctcctcagatgtcccaccacagagcttgctatatagtgggggacatgcgaatagggccctccctctgctgatgaaaaccagcccagctgaccctgcagctctgggagaggagcccagcactggaagtcggcggtgtttccattccgtgatcagcactgaacacagaggactcaccatggagtttgggctgagctgggttttccttgttgctattttaagaggtgattcatagataaatagagatgttgagtgggagtggacatgagtgagagaaacagtggatgtgtgtggcagtttctgaccttggtgtctttgtgtttgcaggtgtccagtgtgaggtgcagctggtggagtctggggaaggcttggtccagcctggggggtccctgagactctcctgtgcagcctctggattcaccttcagtagctctgctatgcactgggtccgccaggctccaagaaagggtttgtagtgggtctcagttattagtacaagtggtgataccgtactctacacagactctgtgaagggccgattcaccatctccagagacaatgcccagaattcactgtctctgcaaatgaacagcctgagagccgagggcacagttgtgtactactgtgtgaaagacgcagtgagaagtcagtgtgagcccagacacaaacctcctgcagggtacctgggacaatcagggaaagcctgggacactgtatactgggctgtccccaggggcaagtccaggtgatataagcctgggtttcctgtcatgatctagggttgcattgttagcaaattaccccagggaccatctctagatttccaattctgtaataacatttgatgtcgtctctgactgcacaatgtcccctcaactttgtatcttttttttttttgtaacaggaggacacatcctcaccctgcagaagcctgagtgtcactttgggggcagaaatgacctgccttgatcacattgatcactgtcctgaggaaaataccccacaggggaccccgatgactccagcaaaggctctgcctcaaaaccattgaagagtccttcctttcattagaattgaccacagcacctgggcttcagcacaagccataccacagacgtcacaaagcagcagcttgacacctgatccaggtgcattttctcacctttagaagctgagagaggggtgtattctcaaggtcaacacactctttgtgggtttttacacagaaaacctgcttttactttatttcatttgaagataaatgaacaaatgtgcatctataaatgattgtaattttcacatttattccaaatccaatatttctgaattctgcatgatgtcctggcacagggttgtgttttctacaggtatttttcatcaaaccaagaaaatgcattttccactttccgtggtttttctccatgtgcagaggccttgagtagagcacgtctgactgtgtttgttttcacgctgctgataaagagaccttgagtagatcacgtctgactgtgtttgtctgttttcacgtggctgataaagacataccagagactgggaaacttacaacagaaagagttttattggacttacagttccacgtggctggaaaggcctcacaatcatggtggaaggtgaaaggcacatctgacatggcggcagacaagagaagagagcttgtgctgggtctcccctttttaaaaccatcagatctcatgagactcattcactattaagagaacagtgcaggagagacacaacccccataactcagtcacctcccactggtccctcccacaacattgagaattatgggagctacacatcaaaatgagatttgagtgaggacacatccgacccatatcattccaccccaggttccctcccaaatctcatgtcctcacatttcaaaaccaatcatgccttcccaacagctccccaaaggctaaactcatttcatcattaactcagaagtccacagtacaacatttcatctgaggcaaggcaagtcccttccccttatgagcctgtaaattcagaagcaagttacaagcattgggtaaacacacccattacaaatgacagaaattgcccataacaaaaaggccccatgcaagtccaaaatccagcagggcagtcaaatcatagagctccacaatgatcacctgtaactccccttctcacatccgggacatgttgatgcaataggtgagttccgatggtcttgggcagctccacccctgtggctttgcagggtacagcctccctcctggctgctttcacaggctggtgttcagtgtctgtggattttccaggcacaaagtgcaaactgtcagtggatctaccattccagggtctggaggatagcagccctcttctcacagctccactaggcagtgccccagtaaggactctgtgtgggagctctggccctatatttcctttcctccttgccctagcagaggttctccatgaatgatccaccactgcagccaacttatgactggacatccaggtgttttcatacatctcctgaaatctaggcagaggttctcaaacaccaattcttagcactctgtcgataatggttcattttggtggcctgttcattactggtattttccaaaggaatctcacttgaatctttactcttttgcattttgtctccatgacaatgttgggaagttttacctccaccatcataacatgatctagtgatctcacacatttgtggcaaacaatacctacaaattcagaagctctttgcttttctttccatgaaatataattctttctgttctgtgtataagcatatcttagcaactctgtgcacacccacatagatgtccacaagcctatgaattattctctgtaaataaaaatttatatcaatttccctcaatgttcataattctcctgagggtgaggaagctccttctcgatctgttcaaacaaaatgcccagaaaccatctggtaggtaaggagttcacctggctctggtgtggggtctgtctctttccctctgttgtcacacaggtcagcccagttgttcaggtcctaagaagaaagcccaggtttgtcctgattttaaaacacatcaaacttctgatgactctcctgttacccacatccatggaggatagattatttattatataattcaccaaactaatgtcaaatgcccaagttgcaataccacacatcctagggtatgttcatgcaattcactggaggagaaagtctttcagagacagatggatctgaaatgataaatatgtgggtaaggactctgggcttgagtatcattgtccagccatgtttcacaagtgtgtcctgtcaggggaaggacaagagttccttgtgttctcagagggaaggggtcacagagttcctctctggttcccaggaaagataatcgcactaatcttcatgatcttcatgagactatcctccagtgctgacctgttatagagtttttgtctgaagttctcactgcaatccccaatctacatattttcaatcagaagtgtttagagggcaggacatatcttcacggacacacattgagaaggatgtagatatgtcccactaccttctcctgagatctcagacagaatcccagatttcaaaaggacacagaaggacagctctcaggtgcttttaaaaaatgacccacttccagggacagggagcttccctataaccatggtggatgttctgaactacaataaacattggatggatccaggattgtttgaagtcactgtcattattacattcagctgctgtttcaatgtgtctgaagtagtaaatgacaatttagatgacaatttatatgaatcttcaagggtagaacaatattgaccatattccaaaatctgtccttgatccatgatcacactcatctcccagaccaggtccttcagcacgtctctttacctgaaagaagaggactctgggcttggagaggggagaccccaagaagacaactgagttctcaaagggcacaggcagcatcctactcccagggcgagcccaaaagactgggggctccctcctcctttttcacctctccgtacaaaggcaccacccacatgcaaatccttacttaagcacccacaggaaaccaccacacatttccttaaattcaggttccagctcacatgggaaatactttctgagagtcctggacctcctgtgcaagaacatgaaacacctgtggttcttcctcctcctggtggcagctcccagatgtgagtgtctcagggatccagacatgggggtatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagacacagtgaggggaggtgagtgtgagcccagacacaaacctccctgcatggacgcggaggggaccggcgcaggtgctgctcaggaccagcaggtggcgcgcggggcccccagagcatgaggccgggtcaggagcaggtgcagggagggcggggcttcctcatctgctcagtggtctccgtcctcgccagcacctcgctgtcaccagggctcctctttctttattatctgtggttctgcttcctcacattcttgtgccaggaaagaaacgaggaagacaaattttcgtctatagttgaagcttcaccaattactaggaacttgcctacaagttcctgcatgacccattataacttatcgattaaaaaatatatattctaatgcttctcaccatctcttgatttgtatcatcaactgaattgtaccctctttgaaattcatatgatgaaaccttaaattcaatggatctatattggaattttaatgaaataattaaggttaaatgtggtcataattgtaagaccctaatgcaatagacgtgttgtctttataagaagaggaagagacaccagagacctctcacttttcacgtgcaggcagagaagaggccatgtggagacatagtgcactagaaggtggcccagtgcaagccaggaagaagccgcgccaagaaccagccctgccagcacactaatcttcaacattcagactgcagaattttaagaaaatcagtatttgttgtttaagccacccactcctgttgtcttcttatgaagatccagacagactaataccacataactctgttagtgctgtcccctggatggagaattagcctcctgaggctgggcacatctctcagatttccacataaaacaggtaaaaaatagtagttctgatataaaaacttgtcatgtccctgttggccaatttctgggcaaggtcttttaaataagccaagtttgcggggaaatggagaccatatgtttgtgggactctaaccgtggaatctactgcattgctctagcagaatcaaaaattgaacaccagtgagctctttattctcattaaaatgtgtgtctttggaaatgttaacattctgtccagaatctgtgctcacaaacaactgtgtttcttagtgcactcttggcctggtggagccctcgcagaccctctccctcacctgtgctgtctctggattttccatcacaaccagtgtttcctgctggagctggatccacgagtccacatgggaaggactggagtggaccaggcgcacacgtcatgaagggagcaaaaattcccacccactccttatgaatccagtcaccatctccaaattcgggtccaaaaaacacttgtttttacagtggagctatgtgagcaacaagctcacagccatgttttaaagaagagacagagtgaggggaccacggtgcgagctcacacccaaaccttcctggaggggtgcacaggacagcaggagtcccgatgatggaagggggtggtctggattccaggtcactctcaagatcattgtagaggcactcagctcacccgggggctctcaggagccatcgaggtaaatcaggacaccagaagagactcggtacagcagggggctctggaccattgtggggattcagaaacagcaggttctaggctcagccttagggcaggttgagatggggtgaaaaggggctggatgagggtgtttgtgtcaccataatatttcaccactagacacccgccactacatgtgttctactgcatatgagtgtatgattagaaaatcatacttctataaatatataaccatacgaaggtgtgtcaagttttcctcttcaacttctatcggccttgttcgtaaggactaattccctgtaattacttgaggacctcataaattgtggtcaggtttgtaggtttcctctctttccttgtctccctttccccttattctctctcacacaaatggacataatccccactccacacgcaaagaaatctataactttcattacctgatgtattgaataaaattgattaatgtgcagctttcccatctttgttgttgttcatgctgctgtaagtataagaaccatgagattctcagctgtgtacttctccaagctgagtggcagctttgcttatcatactgagatggccaacaatccaaatgtcaatcatcagcttaactggtaaacaaattgtggaaaagtcattcattggcatactactgactgtgaccacaatatactaatgttggatacgctcaacagtatggttaaattctcatatggtgagtaaaatgagccaaacaaataaaagtacacacatatgataccacttttatacattctcccatccaagtactaaccaggcccgaccctgcttagcttccgagatcagacgagatcgggcgcgttcagggtggtatggccgtagacacacttttatacattctatagaataaaaactaaagttacataaagaatcagtagttcactgtgaatattatagaagggaaagtgtagacaggaggaattacagaaaagagaaaattttaagcataattgacttgttatctatattgataataatgatgtctatgataatatttgtacaattgaacacttcatgtgaagatctttttttttagtttaacatcattaaagatagtactaactgtaacgtgtgtaatttggtagaaacggagtcagacagagataaaatacataaaaagtcagagacacctgaatattcacatgagtgagcctgcacttctctatgtttttatgaaaacactacaatacagcaaaataatgacatcattttatgacgtgaagggggtttattaaaccactccaggcacgttgtattagtttgttttcccactgctacaaagaactacctgagtttgggtaacttataaagaaaataggttattgactcatagttctacatggctggaaaggcctcaggaaacttgcaatcaaggcagagtgtgaaggggaagcaagagacatctcacatggcagcaggagaggtggggagaaccaccacacactttaaattatcagatctcctgagacctcaatctgagacctcaatcatgaaaacagcatggaggaaccaccccatgagcccatcccctctcaccaggtccctccctggacgtgtggcaattccaattcgagatcagatttgggtggggacacagaaccaaaccatatcacatgtccagttctgtcccagagttggttcaggaatcagatgtgtcctgttaacaggagctgtgacaccaagctcccagcaccacttgtagttgacgtcatgcaaaggccaagatatctcaactaagatttagtgtggatgtgatgttggatggtgacacaccctcagaccaagtggatatggaagggataattatctctattctagacgtgtctgctgagagcagggcagttctctcaggaaagtgcaaaatggcttgatagaacagggaaagagagggcctcagggtttggtggtgggggcagattgagtctttccactcacagaaaggggtttatagggtgggaaactcccactggcttcaaataaggaagctcctgtgattctggaccgatattcaccttgtgtgtaaaaaaggaggtaatggaggaatgagccttaagctatcagcagtcacacaccaaaatacagtgtgacaagttattctatgtagcaactataaaaataatgaataaaaaacgagataagggttcaatatgatgggcaacactcaggtctacagaaaatgagatgagtgtttataagtcaaagcaaataataatgagaagcaggaggagggtgtgcagaattagacaggggtccaggtccagtgacttgggtggaaaccttttgctattaaggattatcagcttagtctgaaggtcttaggtcagctatctgtttaaagacatcagaaacaccagagaatctttgaggatgctcagattaacatctcctattttagtagccttgcagttgtgtgaaaaccttttttatcttatttcattttattatttatttatttatctgttgagatggaatttcgctcttgttgcccaggctggagcgaaatggcacgatcttgactcaccgcctcttccacctcccagattcaagcgattctcctgcctcagcctcccagtagctgatattacaggcatgcaccaccaggcccagctaattttgtatttttagtagagatggggtttctccacattggtcaggctggtctcaaactctcaacctccggtgacccgcccaccttggcctcccgaagtgctgggattacaggtgtgagccactgctccgggccgaaaatcttattcattcttttttgtttgtttttagagacagagtctctctctgttgcacgttgaaagtggagtggtgtgataacagctcactgtaaatttgaactcttggctcacagagtatgttcctatgtatcgtgcaggtgtgtctgtgtgtgtttacccggcttggggtcctctaatttttggatctgtagttaggtgtttcacattcttaagatatttttcttaagaaatatatcttaagatataagtatatcttaagatatcattaattcttaagatattttctctgtttctaatttctatttttgaaatttgaaatatatctacactatactttttgatgttagttcttaaatttcttcactctttttccctttgaaattcactttgtgtaatttccagtaacggagttgaagtccctggtttcatttaagagctgagcgaattctactgctgagcgtgcccaaggtatattcaactttatactgcatcacttttgataattttatgaatttccatttgattctttcttagtatttctctctgtcagtcacctatctagtcttgcactgtgtccacattttctttcagatacttttaacaaattcaattactttaaatatcctacttaataagatagttctagtattgtgtcatttacaaatatcaattctgaggatttttccattatgactttggtgttttttataacttatatgactttgatgaatgttataatttttgttgataaccagccatatttggacccttgatattgacgtattattttattttgtgcatttctgcctgtatttgaccacaccctatctgtgctgggccttgattgtggagatgtctgtgcatctcttcagagctacatttgacatttacttttgcaacggctgtagcagttgaagtgtgttcttctatgtccactggagacttcagatactctagtgataccttgttttcatgcctgcttggctttgtctattcacctcattccattctacagagaatctccttcacattcctagggtggattaaagtgttatatttaactgccaattgtgaaattggcggaaggcattagactaaaggaagaaactgacctctcgttgggccataattctagaaagccgttgtgatcctgagtctgagtgtgaccttccaagttttcccgaccctcctgcaagtgagatactggtctgtgtgttcttgcctcttcccctggggtagagtcctcctgttttccccagttgttccctcccacagctctcacaatctctgttggtgtccccatcttccagatctgctgccatgacctgcagattaaggctctgattccataagaaactgaggggagctgcttctcaatagatctttgatggggacctctgttcccatatcagttcatgaggggctgctccagtgccctaggatgctgattttcatggcttgctcctgcagggtaatatctgagtttcatagtgggaatcagagagttgggtctggatgcatttcagaagtgtgggctctcattctctcccagacagtcactttgggaaggatagattcttgtgactgtaaaggttcttcaagagaatagcacaactcttcagtatgttgtcccttagaatttctcactacaacacgcttaacacactcgacttcaagcaatgcaatgtgtatttgtgctccatcttgtaatggcctacgttgaatacgacagactgtgcctcaggtaatttcatatcttgactttattactctgtacaagaacttgcctctccctagatttcaattttttttgttttaaaccttcagttatctgaagcatttaataaaatttgcgaacttccatcttttctgtttatctgttattgctgatgttattgttttaaaaataaatatatatttctcattcatgtacatttttaagctgagcagcatatttttaagtaaaacctggaataataaaagaatccaaacatttttcagctgccccaaaaaaaccaaattatggtaaatgtgttcactggaacactactcatcacttataataaatatatttctggtacacagagcaacaaagaaaaatatctaagtgtttatgctgagtaaaatacgccagacaaataagaatatgtaccatattactccatttatgcaatttcttttaagtgaaaaagaatctaaagcaatatccagaagatcagtagttacctggaaaaagggtagaccaaaggaaggggaaaggaggaaacttacagaagaacaagagaaaatgttgaggggagttcacttgtccagcttggaaatgatgggttacatcatgttgatcaattgcacactttaaatatgtgaagtctattatctgccaattaacactcgcaaaatttattgcaagcagacaaatgaaaaattagacagagagaggatggtataaagatagaaaatatatattaaatgtcagaaatgtctgagaatttaactcctgaccctagttccgtccttatttttaggtgaatggtagcgtgcaccaaaatcacacacattctcagtacaggaagtgggttccacaaagcacacgaggtatgtccaattcttaccaagatttggttcagggagtaacagtgatgaggaatcacaggcccagataccggggctcactcatctcagacatgacctcgtggacacacacttagcccctcctccatgtgtaggttgacttccacatatgtaaatggagaaaccattgactcctacagaacataatttacagaaatatacaaaagataaaatagtgcaaatacttatcacaacaaaatttcctaataagacagtgtattttccaaataccgtaattgtcacccaactcctgtggggccgtgtcattttatctggggtctgccgtctcctcaggattcccaccccagagctctctatgtagtaggagacaagcaaatagggccctccctctgctgctgaaaatcagccaaatcctgaccctgcagctctgggagaggagcccccgccccgggattcccagctgtctccacttggtcatgaacactgaacacagaagacacaccatggagtctgggctgagctggattttccttgttgcagttttaaaaggtgatttatggagaatgagacacactgagtgtgactggacataagtgagagaaacagtggatttgtgtggcagtttctgaccagggtgtctccgtgtttgcaggtgtccagtgtgaggtgcagctggtggagtctgggggaggcttagtaaagactggaggggtctctgagactctcctgtgcagcctctggattcaccttcagtagctctgctatgcactgggtccaccaggctccaggaaagggtttggagtgggtctcagttattagtacaagtggtgataccgtactctacacagactctgtgaagggctgattcaccatctctagagacaatgcccagaattcactgtatctgcaaatgaacagcctgagagccgacgacatggctgtgtattactgtgtgaaagacgcagtgagaagtcagtgtgagcccagacacaaacctcctgcagggtacctgggacaaccagggaaagcctgggacactgtatactgggctgtccccaggggcaagtccaggtggtataaggctgggtttcctgtcatggtctagggttgccttgttagcaaattaccccagggaccatctctagatttccaattctgtaataacatttgatgtcgtctctgactgcacaatgtcccctcaactttgtatcttttttttttttgtaacaggaggacacatcctcaccctgcagaagcctgagtgtcactttgggggcagaaatgacctgccttgatcacattgatcactgtcctgaggaaaataccccacaggggaccccgatgactccagcaaaggctctgcctcaaaaccattgaagagtccttcctttcattagaattgaccacagcacctgggcttcagcacaagccataccacagacgtcacaaagcagcagcttgacacctgatccaggtgcattttctcacctttagaagctgagagaggggtgtactctcaaggtcaacacactctttgtgggtttttacacagaaaacctggttttactttatttcatttgaagataaatgaacaaatgtgcatctataaatgattgtaattttcacatttattccaattccaatatttctgaattctgcataatgtcctggcacaaggttgtgttttctataggtatttttcaacagaccaagaaaatgcattttccaatttccctgtttttcctccatgtgcagagaccttgagtagagcacgtctgactgtgtttgtctgttttcacgctgctgatgaagacataccagagacgaggaaacttacaacagaaagagttttattggacttacagttccacgtggctggaaaggcctcacaatcatggtggaaggtgaaaggcacatctgacatggcggcagacaagagaagagagcttgtgctgggtctcccctttttaaaaccatcagatctcatgagactcattcactattaagagaacagtgcaggagagacacaacacccataactcagtcacctcccactggtccctcccacaacattgagaattatgggagttacacataaaaatgagatttgagtgaggacacatccgacccatatcattccaccgcaggttccctcccaaatctcacgtcctcacatttcaaaaccaatcatgccttcccaacagctccccaaaggctaaactcatttcatcattaacacagaagtccacagtacaacatttcacctgagacaaggcaagtcctttccacttataagcctgtaaattcaaaagcaagttacaagcattgggtaaacacacccattggaaatgacagaaattgcccataacaaaaagaccccatgcaagtccaaaatccagcagggcagtcaaatcataaagctccacaatgatcacctgtaactccccttctcacatccgggacatgttgatgcaacaggtgagttcccatggtcttgggcagctccacccctgtggctttgcagggtacagcctccctcctggctgctttcacaggctggtgttcagtgtctgtggattttccaggcacaaagtgcaaactgtcagtggatctaccattccagggtctggaggatagcagccctcttctcacagctccactaggcagtgccccagtagggactctgtgtgggagctcgggccctatatttcctttcctcactgccgtagcagaggttccccatgaatgagccaccactgcagccaacttgtgactggacatccaggtgttttcatacaccttctgaaatctaggcagaggttctcaaaccccaattcttagcactctttccataatggttcatttttttggcctgttcattactggtatttttcaaaggaatctcacttgaatctttactcttttgcaatttgtctccatgacaatgttgggaagttttatctccaccatcataacatgatctagtgatctcacacatttgtggcaaacaatacctacaaattcagaagctctttgcttttctttccatgaaatataattctttctgttctgtgtataagcatatcttagcaaccctgcacacacccacatagatgtccacaagcctatgaattattctctgtaaataaaaacttatatcaatttccctcaatgttcataattctcctgagtgtgaggaagctccttctcgatctgttcaaacaaaatgcccagagaccatccggtaggtaaggagttcacctggctctggtgtggggtctgtctctttccctctgttgtcccacaggtcagcccagttgttcaggtcctaagaagaaagcccaggtttgtcctgattttaaaacacttcaaacttctgatgactctcctgttacccacatccatggagatagattatttattatataattcaccaaactaatgtcaaatgtccaagttgcaataccgcacatcctagggtatgttcatgcaattcaatggaggagaaagtctttcagagacagatggatctgaaatgataaatatgtgggtaaggactctggacttgagtgtcattgtccagccatgttgcacaagtgtgtcctgtcagggaaggatcagagttccttgtgctctcagagggaaggggtcacagagttcctctctggttcccaggaaaggtaatcgcactaatcttcatgatcttcatgagactatcctccagtgctgacctgttatagagtttttgtctgaagttctcactgcaatccccaatctacatattttcaatcagaagtgtttagaggccaggacacatcttcaaggtcacacattgagaaggatgtagatatgtcccactaccttctcctgagatctcagacagaatcccagatttcaaaaggacacagaaggacagctctcaggtgcttttaaaaaatgacccacttccagggacagggagcttccctataaccatggtggatgttctgaactacaataaacattggatggatccaggattgtttgaagtcactgtcattattacattcagctgctgtttcaatgtgtctgaagtagtaaatgacaatttagatgacaatttatatgaatcttcaagggtagaacaatattgaccatattccaaaatctgtccttgatccatgatcacactcatctcccagaccaggtccttcagcacgtctctttacctgaaagaagaggactctgggcttggagaggggagaccccaagaagacaactgagttctcaaagggcacagccagcatcctactcccagggcgagcccaaaagactggggcctccctcctcctttttcacctctccatacaaaggcaccacccacatgcaaatcctcacttaagcacccacaggaaaccaccacacatttccttaaattcaggttccagctcacatgggaaatactttctgagagtcctggacctcctgtgcaagaacatgaaacatctgtggttcttccttctcctggtggcagctcccagatgtgagtatctcagggatccagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagacacagtgaggggaggtgagtgtgagcccagacaaaaacctccgtgcagggaggcggaggggaccggcgcaggtgctgctcagcgccagcagggggcgcgcggggcccacagagcaggaggcccggtcaggagcaggtgcagggagggcggggcttcctcatctgctcagtggtctccctcctcgccagcacctcagctgtccccaggggtcctctttctttattatctgtggttctgcttcctcacattcttgtgccaagaaagaaatgaggaagacaaattttcgtctgtagttgaagtttcaccaattactaggaactttcctagaagttcctgcatggcccattatagcttacagattaaatatatatcaagcttctcatctcttgatttgtgtcatcaactgaattgtgccctctttgaaattcatatgcagaaaccttaaattcaattgatgtatattggaattttaatgaaataattaaggttaaatgtggtcataagtgtaagactctaattcaacagacgtgtcgtctttataagaagaggaagagacaccagagacctctcacttttcacgtgcaggcagagaagaggccatgtggagacgtaatgcactagaaggtggcccagtgcaagccaggaagaagcctcaccaagaaccaaccctgccagaacattgatcttcaacattcagactgcagaattttaagaaaatcaatatttgttgtttaagccacccactcctgttgtcttcttatgaagatccagacagactaataccacataactctgttagcgctgtcccctggatgcagaatcagcccgctggggctgggcacatctctcagatttccacataaagtaggcaaaaaatagtagttctgatataaaaatttgtcatgtccctgttggccaatttctgggcaaggtcttttaaagaagccctgggggctttgtcacaaaagttgccttttatcatttattaggacataactgatgaacaatgagtaccagttggatggagactgaccactgaccatcttctgctgtctcctaagtatgccacagaaaaccacaccaacattactctatgtcttcaactttctaaatttgcactgattggtatttaaggcaggcccagcgttgaataactcctttagtttttgcttctctgggaaaggtcttatctatcctggccttggtcttcaagtttcagcaattctgggaagccaaggacgcctctatctcctcctccatgctctgcaactcacctgagaacagctttctcattggaatgtcttctgtttaaggaataagagtccctgtttcaggcttgggtgcctgagtacacctactggatccagcccaggattggagaaactttccagaacacatcacctgagaaatgaccagtcacactgttacactttcacaatttccgcttcctcatgagaaaattaaaattgcagagactttttcataagcgttgtgccatgtcctttcttgttttcttgcctgttcatttatgtcagaccaggtgccacatctatgtaatcaggttagaatcctgcctccagtaacacatgaaaaggacctatggttgtacttttggtctttgctccaaagtgtaaagattacaaaagtcatcaccctcattcttatgccaagagtcatctgcacaatctgatcttcaatacattttagaatccatcaaatgaatgaaattccattttttaaattaccaccccaaaaactagagagatgggcatgtccagaatagcagttgatggttgcttaactggaagagaagtttcagaagccacaagctgttgaaggcacttacgtggttagcactatagacgtctgcaagacagatgtggactagggtgaaatgacagttccagagggccgcactctcctcagtcttctggaatttccctctagaaatctccagaatctaaaaaatacaatccaaatatgtttcctatgggtcataactggggaagtttaattactgaaaaatataccaggagccttctccaaaagatcctacagggaagaacttttccagaacctcatactatgtgaagggaagaaaaatctgcccattccagatccctccccacttcctccattattatacaaatgagtaaggttagccaatagggtaagatgtaagcaaatagtccagggaaactgaagccacaaaaaggagtaaagatgaaaattcagcttttcccctggagatgcctggtcaaggtcacagcccagaaaaggaatctgattgagtctctaggtttccatggtcagaacaagcagtgctgacccgcactgcacaatcctttctaaccaggatgatggctctggattaaatatgagagtgtgccaatgcacagtctctgaggagaacatagggacactaaaaaagcaatggcagggagttagacaaggacagtagagcaatatgaagcctctgacgtgaacatttttaaaaacaagatcttggaaactccctcattcacctcagcttcttttatcatgaagactttccaagattcttaactgagacaaagaaaataacaacctgcatgcacttccgaagtctccgcttgtatcctgtttgctttagatctctaggagaaaaatgtcagacacctgggcctagtgtcaatgtgggaggcactttctacagatgaggcgcaagaaggaagggaaaacgtgtgttattggaatagtggatatgaagtgtgctctcatctgaaagcatctgcacctgctggaaatctcagatgcaacattcaactgcaagaaccaaggcacacccaaatctcctgtaagattttggattcattatccactgattcagtgcaactggagcttcagagaaggggctccctcctgtgtcatagcatccttgctttgagttcattagatttagtaaggctaatcaattgtttgaagagatggtgtcagcagcgtatgctgtcactgaaggagtattctaaaccaggacaaagccatttcatgttaggcgagggaagctggcggaaaatgctttatgagccccacaggaacttccttgcaaggcaagggctgggctggagggggcgcgcaggaaccgcccagcacaggttccatccccggaggggtgcacaggaggctggggacgaggttccctctcagcgcctgtgtcttcctttggcaacaaaaaaaatcctaagtgttcaagaagttgctgatgtgtctttaagtatcctgttccgtcagagcctttcctataactgaaggcaaccagaactgtgttttaaagtcggttccgaggactgcaagtatcttaatagtgaggatataaaggataggaatggttttactaattgaaaggatacagaattgtggggttccgaggactgcaagtatcttaatagtgaggatataaaggataggaatggtttcactaattgaaaggatacagaattgtgggagtcactatgttcctatgaataaaaaattcagatttcagtgttaagtaatgttgcctacattgtgtgagtgacagggcagtggtggatctgagagtgtggcaggtgcacagacctagtgagtcagaaatcaatatggaaagatgaggatctatggatatgaactgaaagtaagtaaacagttcatgaaattctattaaatggagtaggaaataaaacccaaacttatccaaaacacaaattccttggcgattattttgggagcagtgagttcatcaggaaccccaaacttctcttacgtcttctgattcctgttgtccatgagatgagaaattcagctctaattgtgcatcacagggcaaatctgtaaaccaggagtgtttctattgaggatcatggtggatcaggattccaggcaggtgctggagacactgtctcaggagcgcccagatgatctcagggggacctgctggacactcacgtggaacatcagcagtcactttctcagagtaaccagtgagctgtgctggtgcctgatgggactaggatggggtcaaggcaccttctcagtgtcatggagagtgattgttccagaaatcatccaggtggtctctacgctaatcaaatatgggttcacagggaggaacatgtgctctgggtgcttggtcttcagtgaaaggacgtctggccaccaaaagtttgtaaatggagcagggcatgcatttcctcaaggaggattagggcttggagcatcagcatcccactcttgtaaggctgatgtgtcatttaccttccctttcttatcccaaatcagggtcttcagctatgaaatgctctgactcatgaatatgcaaataacctgagatgcactgaggtaaatatggatatttgtcagccctgagagcatcatccagaaaccacatccctccgctagagaagcccctgacggcacagttcctcactatggactggatttggagggtcctcttcttggtgggagcagcgacaggcaaggagatgccaagtcccagtgatgaggaggggattgagtccagtcaaggtggctttcatccactcctgtgttctctccacaggtgcccactcccaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagacacagtgtgaaaacccacatcctgagagtgtcagaaacgccaggaaggaggcagctgtactggcatggaggggatgacaaaggttattagattgaagattttcttagaaaacgacttcaagtcattaaagaagaggaacaacataaatgtgtatttgtgaaattttaattgagagatttttcatacaacatttattctgtaagctatttcagggattggaatatgaatcaaattaataaagctgatatagacatcctctgaaggcatcttcgtaaacatcaatttctgaatcagtgttgtaaatattttggaacacagacacaagatcacatttttactctacttttatctctatttttaaaaaatgccaaaaagaatcttattttgtgcatgccccattttgaattcccaccgtcaatgcatgatagttcttggttttcctcattcaagttgtcatttgtcattaagagtgttgtgtgttttaaccattctaataggtgagtaacggtatctaatttttatttaaatgcacatgtccctaaaaaattcatatttaacaatttttatataatttttggtgagatgcctctcgtgatatttggttcattttttaaatgcattttttatcagttgtaagtatgcttgcatattgattataaaagtcatttaacaaattaaaataattcatttaacaaatatgcatcttggaatttttttctccaagtctgcagttgtcttttactcccttatccctgtgtattgcagaaaaatgtttgtgtgtgtgtgtgcctgtgtatgtacaaatttagattttaaaaatgtacatttttattcatttaaagatcatgtctttggcagtatatctgaaatctcattgtaaaagacacaatagtcattattttttccatgtctctaatcttaggacacaatcaactcatgagtgtttaaccttccctacctgattggaggactatccacctgagacatttggaatacttctgtaaggagatgtgtccttcccattatttctttatttagtcatctattgatgttcctattggtttatggatgtctatttcatactccgaagaagatccttgttacattacttgttttattgttcaaaacaccacagctttattaggtgctgggagctcatttagtttggatcctgcatccttacagcacacctcatctttttgtttttagacatttccctgtttccaagtattacaataaattctaagcttgttctctacgttaccttttttgtacatagaatcagccatttttctaaagactgctcgtttttcatgttaaagaacagtattgaaatttaaaaatgtgatcctgggtatgtgtgttgttaatgtggtatcagtacttcttctaggatatctccaccaattggcctagtaaatgggcatgtttataggaacccaagtttatggacacatcgaaactatttatgtatctaatcctctgtaatgtgattacattaaaaatgagaacacactggtgtctccatccaactatgctaccatatggatgtttccagccttccttccctcactgtccataaccacccactgcaaagtgaggaaccccatcccaccatatgccattttattacttagctgcacaatttcaggacacatgcatagcagtatcagaaatgtaaagctcgttggaaacatgtttatctactagaacagactgcttatgtgcagtttctttacactgtaaacttatagaatttcttcattttcaaagttgcttaggtcagcaacttcattttccactctcctcagtgaagtcatttcaatgacaatgtataatgtcatttatttgaaattctttcaaagccaaaactatagtccggtaaacatatagaggatattcaaggaatttagagagtgggtataaaataagtaaaaatggcactgtttaagaagagtaaaattgtttttagtgatatacaatggttgagacacaacacaattaatttggctaagctcatacttttgtgacagaaaatataaacctaaatatatacaatttttgtaaaaaaactttagcagttcattaaccccagggttaaacaagactgtgtaaaattatctaataacttatttgatgagggtggggatatcatgagacatatgcaacaaagaatgaaggcattttcctcatttgcatgtaagatgttaccattcactaaagacctttaataaaaaaaaatttctacgtgatccagtatttttttccttctgtcaagcaaataactcataggattcttttctttccttggttgagaaagattttcctacaagcttcagcacacgtcaggcatacactgtccctgaatgggcatttaccctcagatgggtacacacacctgtcaacatgggggctcttctgtcagacaaacacacctttactcatgtggattcttccctcagacaaacacacatgtccccacgtggactctttcctcagattacaacatttgtccttacatttactatttcctcagaaaacagacattgcatcatgtggtctcttgtctcagacaagcaaacatgtcttcagtcagataagtctgtggatttccacattgactgtttccttacacaagcacctatatccaatatttaactgttttgtgagaaatttatcccttttctctggaaatgtatttttatgttcttactggacatattttttaataatgtttggtactatgaagatacccgaacactgtccatacgagagaataagaaagagtaataagcagattaaccctgtgcatccagacccaggagtcctttgatcctgcccttccgaaatggagacacagaggaaggatgagcaatgctgagcagtgcacccatgaccacaaaaggaaagacatggcaatgtgtcccctcccctcctcatgaaaggcagctcatcccctgttccttcaggccctggtgaggagccaccccatgtatattcccttgatcagtgtccacaccatggggtctgcactgatctgggcttcccttctcatcaccctcaatattagtgtcccttgtgaatcaggtccagctgcggctgttccacatggggccgttcttccatttcctcagtgtttgcagaagtcctgtgtgaagtttattgatggagtcagaggcagaaaattgtacagcccagtggttcactgagactctcctgcaaagcctctgatttcacctttactggctacagcatgagcttggtccagcaggcttcatgacagggattggtgtgggtggaaacagtgagtgatcaagtgggagttctcagagttactctccatgagtacaaataaattaacagtcccaagcgacaccttttcatgtgcagtctaccttacaatgaccaacctgaaagccaaggacaaggctgtgtattactgtgagggacacaggagagggaatatctgtgtgagcccagacacaaaaatctctgcagagagacaggagggaactgcatggtagatgctcctcataaccacaaaggggcagtcaggaccatcaggaggagctcaggacacctgggggtgctcagaaccatgaggggtgctcaggacatcgggggctctcagaaccatgaggggtgctcaggacatcagggggctctcagaaccaccagggggcgctcaggacacctgggggcgctcagaagcatcaggggtgctcaggatatcagagtgccctcagtaccacgagggggcgctcatgacaccaggggcactcagaaccaccagggggggctcagtacacgggggttctcttaggaagcagctccacatcaggagcctgagaggctgtgattgcgttttaaacctgggtgattcccgacctggtcaagaaaaagtctcccccaggatctctcaccatttcttcttggtaattccatgatttttttttacctacaaaacattaagttagaacagggatttaattcaacttttaattctgcagattttccgagtaatagtagcaatgttccctcaggacaatttttaaaattggctatttatatattttatttatgtaaaatgatactatcttgaaaatagtaaaatttttaaaatcatacctctaatcccagcactttaggaggttcgggcaggcagatcagttgcgctcaggagttttagaacagcctggcaacacatttagatcttttccatacaaaaagaaaaagaaaaagaaaatagctaggtgtggtgctacctctggtaccagctatttgaaagtctgaggtgggaggatcccttaagcctgggaggttgatgctgcagtgagctgtgattgtgccactacactccggcctggttgacagagtgagaccctttcttaaaaatacaaactgtttcaataagtagagctttgtgtctttgtgctgtaataatcagttgtatatattttctaactgtaactcagcatatgcatggtgttctgtttctttttctttcatttgctgttggtggaaattaaacacctctttaaacgctcttgttctcccctttggttcgcttcgggtgtcctgtttaacagactatttcttcatcttccctttttctttgaaagtctttttctttctcagtttccatgcaggataaagaaagtccctttactttctgtcctccaagtctggtgaacagctcccttctcttcataaccactgaagccaaccaagtttaggaggataacagctctccttagaatatgctcgtctacctggagactctctgccctcctcacccttttctagggtcctgcacacatcacactcatcccatcccctcccttccctaagtaccacagagtgggctctgcagttcctgcttccctgtgtgtgctcagccctggggctcactagtgctttgatgatgacgttcaaatccccatgtgcttagactctctaagaccaccctctaggaagatgccattgtgagtgagtcctggaaatcatgggctgtgttcagtttcatattgctggatcttctctattttaaaggaatactggcaattaagattagagtttgtattgaatattcatgccaaaaaagttttctttcaaaacttttcaaataaaacaatttttcctgcctagtttgaaaactacaatgtaaattcaacaaataatataatacaattttaaaggtgacgtttgtcttattggttattcaatttattaaaaacagaagatatttaaaataaattccattgcacatttaagtgatgtatttgacaagaatggcatttacatacatttttaccaaaacacgtatttaaatatatttgtctttttaatattggtagaggcagacatacacgtagaaaagcatcattttgtactacaatctcaaactgtaaacacaatttaaattcagttaaataattagaataatatgaaacaggccgggcgtggtggctcatgcctgtaatcccagcactttgggaggccgaggcgggcggatcacgaggtcaggagatcaagaccattctggctaaaacggtgaaaccccgtctctactaaaaatacaaaaaattagccgggcgcagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaatgaaacaaataggtgcgttgttttggtgtttagatatacattcacttttgcatgggcacatgtatgtgtctttgctgggctgttgtgtatgtatgtgtgcttgtatgaccatcaagttttcaaatacatcattaaatttcatagttacattcgtcttggccaggcacggaggctcaggcctgtaatcccagcattttgggaggcttaggcaagcagatgacttggagttaagagttcaagaccagccttgtcaacatgccaaaaccccatctctacgaaaaatacaaaaattagccaggtgttgtggcacgtgcctttagtcccagtgcgacagggaaatgctgggtcagaaatcccacacaaagtctctacttggttaccacctaatggaactgtaggaagaaagccaccatccttcagaacccagaatggtagatccactgacagcttgcacagtgtgcctggaagagccagaaacactcagtgacagcccatgagtgtagccagaagggagattgtgccctgcaaagccacaagggcagaactgtccaagaccatgggaacccaccagttgcatccggtaacctggatttgagacatggagtcaaagaagactattttggaacgttaagatttgactgcccagctggatttcagacttgcacgtggcctgcagtttggaccaatttctcccatttgcaatggctgtatttacacaatgcctgaacccccattgtacctaggaagtaacttgcttgttttttattttacaggctcatagatggaagggagttgccttgtctcagaaaagaccatgggctgtggacttttgagttggggctcaaatgagttaagacttcaggggcctgttggaaagtcatgaatggttttgaaacgtaaggacattagatttaagaggcgccagtgttggaatcatatggtttggctgtgtccctgcacaaatctcatcttgaattgtatctcccacaattcccacgtgtcgtgggagaaacccagtgggaggtgattaaatcatggagggagttcttctttgtgcgttattgtgatagtggatgactctcatgagatctgatggttttaaaaaacgggagttccctgccctctctttgtctgctgccatctccatgtaagataaaacttgctcctccttgccttccaccatgatgtggaggcctcccaagccatgtgtaactgtaagtccattaaactttttcctctataaattactcagtctcatgtatgtctttattagcagtgtgaaaacagactaatacagcaaatatcaatctcttaaaatattttgttgttctgcatgtaatatagcacagtctaatatgggaggtaaaataaatcatccatggaccttcagatataagtcatagggtaattatgcctgtgtccctgaaggagtgaactagaggttatacacactagtggcactacctttggcaaagggtgttcaggggtttctgaaagttctgataattttaattttaaaattgaatttactatgtatttcttcatcaacctttccagaagatttttggcagtaagaacagcctagtattggagtaatactgatgaattagagagttattttgtaattattctcctgagatttgcatgaatcaattgatatagaagttcgtatgtcccaagttgaaacatcagaatcaagaaggcttcatcacccttaatggctgtggtttttggcaaggcagtacttcaattcagccagaaagagagacaacaataaaactttcaaatgcaggggagtctgacctcagtctctctctcttataaaggcaaaggcaaagctgtgccacatcaagatttttcttcaagccttcagagtcaacattgggaatggaaaagccaatcactttgtccttagagaaggcgaagatctgagaggaatgcagagttgtgttcatgaaggtgatgacattgttatttcttctcctttgcccagtgactgctttcaagttgagtgtttcagatgtcagacctgacttatagggatggttgtgactgcacgtgtctgacaggggctgagactctatatctctaagtgtcctgtcctaggagcagctacaggagtcagccctagactggaagtgccctcactgaccctctgcctcacctgtgcagcctctggccagttgaagaaagttttatccctggaacatcttttgtcaaaaccactccaactagtattcatgacctatggtccacaccctcaagtacacagacatgatcatgctatgacttggtgtctagaagatccctgcacttttaattttacctctaatattagactccactttatcacatgcggacacagcagaatattttaagactttcatatgttatgctgaaaaattcaatagttcataaaagtctacttcccatcactgccagtgtttactactgagtaaggatctgccatcccctagggaggaactataatggatggtgtgccctgttagtggttatgggaatgaatccatcttgtggcaaatggcagcatcttcttgttttgcaagattaaatagttttctatggtgtataaatacaacattgtctttatccatttgtctatctactgacactcagattgtttccatatattggctaagattaatagtgtttcaataaacataggattcaactatcttaacaaggtggtaatttcatctgctttgggtatatttctaaaagcagaatttctggtcatataacatttccagttttaattcatttggtgcctttatattgctttccataattgtgaaaatatagagtggtatagccattatgaaaaacagtttcagttttgaggtatgatccataaacaaataatgtttgattatggctctccatgagaatttctaataaatatgatagaagtcaagaaagcgtctcacattaaagcaaggattaattttatcccttactccctcaaaagcaaaagattggaagcatgcatgatggaggctgttagcagggttcagaatgatatcataaaaggaaactcagttggataaaaatgttgggctttcagtcataggtatgtcgatactcaatatgaaaccgcgaagtcaaatgaggatctagaatgtgttcacttgaaccaacagcacattctcagacgcacctattgctgcatcacaagggtgatgaacttttgaaacaagtaaagtgtgagtgcacagtaagtgataaagttatcacctttacatgaagtttgttcaatatgccaaaggcttgtacagattaatcatacacaaatatacacaatgtatttttgcatacacagatgtctagaggatgattcttttagggaaaattcttcaggtcacagaaatctgtgtaagttggaggtcccatgaaaaagtatctctttataaatactggtctattgctcaattagggaaaatgatctctgttggagaaagcttccaatttgggagatttcttcattgcttcttgagttgtaagacatgaaccaaaaaattgactggagttttttggagtttcatggctggagtttcatggctgtgttgttaaaaatttcttatacggtttctttcaattatttgagatcagtttttctgatttttttctccagtagataaattttcacaagatctcaggaaaccatgtctctggtgctttagtttgaaaaactaacttcctaggtaaagaagcttctgtctaaccatgatgagctcatttcttctgcataccatgaagtttgagaccccattgtccagaatcatgaaaattttacactccagtttactgaaaatcttgactttgaatttaatattgattggcattgacaaaaatggttcattcttggatgtgtcctaagttgctcacccaacatatcagtggactgagaatcttccattagctccctctgtccatagcactgagtctattgacaatctttgcagtcctctatgaaggagagtcctgaggttcatcagattcttgtagacactcagatgaaccaaaggaattaacggaattgaggactgccagccatttccacaacactaggaataattaccatctaagtgtaaaggtctacatcattcagaataccctgcatgacaggctgatgcaaaaaaaaatccaaccctgcagaggcttcacagcaaccctcacagttccttcagggaagaaataatctccaagttcagtgagtcagtaaagctgttctgagctacagtaaacattggattgggcccagttttgtctgagttcaatgtgattgttatactcagctgctgatcctatatggactgagtatggataatttaaatgagcctggctgcgtggtttgttatatgaaaacctgaactaaatataaataaagggcatgtctggactagcatgagggtgagagattctgggagctccaccccccttactcttattgccctttcctccaggaacctccaggtcctcagggtgagaatccacacagatcccttcatggctctattgccaggagaccaaatctctgataaaatcactcagaccttcttcagacagacaacccagggaaagggcatttttacacccttatgtatgtggggaaaggtaatccatacccattagaagcccctgccagcagcctaactttatcatgaaaatgggtaaaattagccaataggggtacatttaagaaaattttcctgtgatgttccatccagaaaagagcaaaaatcagcttcacacctggagacttcctgtatcgggcacagctcagagaaagaagatcaccacagaattaaaatgcaactgtaagaacatgtaatgcttccgtgttccacacattatgtctcaccagtttagtcaatatggattaaatatgagagcgtggcaatgcacaaactctatctgaggaggaaagtcagagaaaaaatgttaaagaaaatatggcaatttgaagcctctgacaccagcaacttcagcaccaaggaaatgatttcaccctcattggcctcaaatttacttttcatggagcattttcagggttccaaagtgagaccaggtgaattcaatgtgcatgcacttctcaggtgtccacgtgtattttgtttattttatttctatttgcagaaagtaaacacatattcagccttagtgtcagtgtagggagtgctttccatgacatgaataccagaaaaaaaggaaaaacatggggccaattaatgtaaaaattagccactgtgtgtgtgtgtgtgtgtgtgtgtaggtgtgatttgaatactagagttggagtgggcttctatccacatgcacctgcacctgcaggtagtctcaggtgcaataatcaactgcctgaccctaaaggaaacaagaatctccccaaacccctgaagagtgtttgggtttaccgtgtgtccagtgattcagtgcctctagagctccaggaaggggctcccccggtgatgcctgagatcttttcttcaggtctcccctgcagagttcctctgggtttcctaagggcaattcactatttcaaaagatggtgtgagaagcacatgctgtcactaaaggagaattctgagccacggcacagccactttatactgggctagagacactggtatgaatatactctgtaagtttagacagaaagcctcgtgcatggtaggggctgggctgcagggggtgctcaggataaacgcagcacagtctcccgccccagagcaggtgcacaggaggctggggaggggttcctctcagggcctgggacttcctttgaaaatatctaaaataagtatttcacaagggctgctgttgtttgtataaatatcctattcaattgtgagcatttatcaaactggatgttgtaatgacaaccacttttacaatggggatttcaaactcccctagatatcttaatagtaagcagctggaggtcaagaagagatcctttcttttaaataagtgcaatttttggagaaacatactcattcccaaaataacgcattcacatattaaggtctagaaatggctcaagttgtccctggtgcattcgaatgtgggttcaaagtgaggtgcgtgtcctgagggagcttgttctccagtggaggaagctctgtcaacacagagttcagggatgtgtaggggtcgtatcgcctctaacaggattacggcttgaaccctcagcatgtacaattgtgtcgtccatctgtcatgtatttgctctatctcatcctggctcaggaattgggctattcaatagcatccttcgtgaatatgcaaatcactaaggttaatacagatatctctgtgccgtgagagcatcacccaacaaccacacccctccttgggagaatcccctagatcacagctcctcaccatggactggacctggagcatcctcttcttggtggcagcagcaacaggtaagggactccccagtcccagggctgagggagaaaccaggccagtcatgtgagacttcacccactgctgtctcctctccacaggtgcccactcccgagtgcagctggtgcagtctgggcctgaggtgaagcagcctggggcctcggcgaaggtctcctgcaaggtgtctggttaaactgtcatcacctatggtatgaattggatacgacagaccccaggacaggggcttgagtggatgggatggatcatcctaccctggtgaacccaatgtatgcccacagattcacacacggtttgtcttctccatggacacctctgtcagcacggcggatctgcagactagctgcctaaagactgaggatgcagccatttattactgtgtgaggtacaccgtgtggaaacccacatcccgagagttttagaaaccctgaggaaggaggcagctgtgatgagctgaggcagtggtgcagcatgtctctaaacttccattttatctaagtttgcattgagttccgctttaatattagccaggaatgtgggatagacgggtgctcctaagaggtccttaatttgcccattttgatgggttttccagaagacgtgagaagccactttgttaacaaagcatcccaaagccatgccctgctccagaaacacgtgtacccatttcctggtctttggttaactgacaagctctcatcagcgcacctgggctaatttctcatcaggtagaaaaatgtgttgtaaagcaaggctaacgttgtgatagcaattcctgctcaataaccttcagcatcgttgttgttgtgttctatcaactaattacgtgacttcaaggttctcattgggagtgtcttataaatttaagggatatatagaagttcccctaattaaaataaaacaattgtgagcacaacctcagtgttcaaccatgtctccacccttcccaccattcaccccaaagaaatgttcacctctcctggaagtcgggttcattttcaaattagttattttttattttactatatcaagattattgtatgtgactactgtagcagaaagtgaattatgggaacttgaagtaaccaacgaaagataaattcagaactaattaaacaagatgtcagaacgtgattggctctagtcttttaaaattcagcaggttatgtaaccaggctttaaatttacacatcttcctgttaccttcacggcacagtcaactcccattatgtaagaaatggcaactgcattcccaagcgtcatccaaaattgtaaaaatagactgggtgaggtgaggagttgattgtttaaattccgctctgaagaagcagcatcaactcaacaaaccaccgcttttccctcagtgactagagctatgtcgcaggccacatggacctaaatatccttgatagagataataggactacataaattgggctgatcatttttatgctgtaaaattaataggtgagtctgcactccagcctgggcaacaaaacaagtcttgcctgtaaatacaaaagaaagataaattaataggtactgactttgacatttcggataataatattttcataaaccgaatttaattatacccacattgttacctacaccttcactgaaaagttcctagttatcatgagttccatcaacactccacgtgttcaaatctggacatccaagagagtctggagaataaaatgcaatgagggcagtgaaacttgcatatattcagcacctcttaactcaggaggactcaatacaccctggaacactctgcttttctgaatggctcacaatgactccagctcactctccaacctcctcaaacatctggcttctgtttgccctaagttcacgctctgctcttagtctgtgctctgaagtctttgcaaaggtgaaaatgagctgtcagatggaacttccttctcacctcagcatggaatttactgtttcatttaatgaccactctttccataatggttgatttctttcagcctgttcattactggtgattttcaagggaatctctattgaatttttacatttttgcatttttgtctcggtgacaatgttgagaagtttttacctctagcatcataacatgatctagtgacctgacacatttgtggcaagcaatacctacaaattcagaagttctttggttactttccacaaaatataattatttctggtctgtgtatgagcatatcctagcaaccttgtactccacacaggtagatgtctacaagcctatgaattaatctctgtaaataaaaatttatctcaatttctttcaatgttcataattcttctgaggatgaggaagatctttctggatctattcagacaataggcccagagaccacctggtatgtaaggagctcacctggctcacctggttccccctgttgtctcacataaggtcaagcccacttgttcaggtcctaagaagagagctcagttttatctgattttacaacactcccaatttctgctgactctcctgttacccacatccatggagatacattatttattatacaattaaccaaagtaatgtcaaaggcccaatgtgcaatattgcacatcctagggtatgttcatgcaattgaatcgaggagaaagtctttcagagacagatggatctgaactggtaaatatgtgtgtaaggactctgggcttaagtgtcattgtccagccatgtttcacaggtgtgacctgtcagggaagaaccagagttccttgtgttctcagaggggaggggtcccagaagtcctctctggttcccaggaaaggtaattgcattaatcttggtgatgagactatcatccagtgatgatgtactatagagtttatgtttgaagttgacactctatcgcaatctacatcttttcacacagaagtgtttagaggtcaggccacatcttcaggatcccacattgagaaggacagagatatattccactaccttctcctgagatctcaggcagaaacccaaatttcaaaaggtctcagaagggcagctctcaggggctatttaaaaataacccacttcgtgggacagggagcatccttctaaccatgatggatgttctgaactacaataaacattgcatggaaccagggtctgaattcactgtgattattacactccactgctgtttcaatgtgtctgaaggggtaaatgacaatttagatgacctgggtgtgtggtttgttttacataaatcttcaaggatagaacagcattgaacctattccaaaatctgtccctgatccaagatcacactgatctcccagagcagcatcttcagcacatttccctacctggaagaagaggactatgggcttggtaaggggaggccacaggaagagaactgagttctcagagggcacagccagcttcctactcccagggcaagcccaaaagactggggcctccctcctcccttttcacctgtccatacaaagtcaccgcccacatgcaaatcctcacttaggcacctacaggaaaccagcacacatttccttaaatttgggatccagctcacatgggaaatactttctgagactcatgggcctcctgcacaagaacatgaaacacctgtggttcttcctcctgctggtggcagctcccagatgtgagtgcctcagggatccagacctgaagatatgagatgctgcctctcatcccagggctcaccgtggttctctctgttcacaggggtcctgtcccaggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaagaaccagttctacctgaagctgagctctgtgaccgccgcggacacggccgtgtattactgtgcgagatacacagtgaggggaggtgagtgtgagcccagacacaaacctccctacagataggcagagggggcgggcacaggtgctgctcaggaccaacagggggcgcgcgaggccacagagcccgaggccgggtcaggagcaggtgcagggagggcggggcttcctcatcagctcagtgatctccctcctcgccagcactcagatgtccccagggctcctgtttctttattgtctgtggttctgcttcctcacatccttgtggcagacaagaaaggaggaagacaatttttctgtttactgttgaggtttcaccaattactaggaactttcctacaagttcctgcgtgactcattttaccgtatatgtgtgtgtgtataaatatatacacatacacacacacaccatatatatacaccatatatattatatagatacacaccatatatattatatatatacacaccatatatattatatatatacacaccatatatattatatatatacacacgatatatataatatatatatacacaccatatgtatattatatataaacacaccgtatatatatatggtttctcaccatctcttgatttgtgtcatcaatggaattgtgccctatttgaaattcatttacccaaaccttaaatccaatggatctataccggaattttaatgatgcaattaaggttaaatgtggtcaaagtgtgagaccctaattcaataaaccagttgtctttataagaagaggaagagacacccgagacctctcacttttcgcgtgcacacagagaagaagccgtgaggagacgtagtgcactagaaggtggccctgtgcaagccaggaagaagccgcgctaagaaccaatttttacagctccttgatcttccacattcagactgcagaattgtaagaaaatcaatatttgttgtttaacccacccactcctgttgtcttcttatgaagatccaaacagactgataccacgtaattctgttagctctggttcgtggagggaggagcagccccctgaggctggacacttctctcagatttccacgtgaagtaggtaaaaatagtagctctcatataaaaatgtgtcatgaccctgttggccatttttgagcaaggtctctgaaaccagcccttgtgtgtgtgtcacaaatgttttcttttatcttttatttggacataacacatagacaaggcgtaccagctggatggagactggtcactgcccatcttctgttgtctccttaggatgtcacagaaaaccacaccaacatcaccaacgtcactgtttttcttcaaccacctcaaaccgactatagaaatgatccctgcagtataagtctatttcttcaaactttctaaatttgcactggaatctcttcctaaatggggagctacatggggtctgagttttgttcctttcttcccagtcttccccaagtgccaaggacagaatagacttaaaataaaatttggccgtcagtggccccaaccccacatcactttctaaaacccacatcctgcatccatccttctctggacacccctcatcgggctacctacgaatggccagaagctgccatcaccttctgggctgaggccacgagttatacacacgtgtgatttcagtcacacacactctactgcaggacacacctgtgttcttgaggcactcaggcaccctgctgatctcagtcattctctaataaattacacatctcttattaataaaggtccagatggtcccatcagctgcagagcagtggagtaaagctcatgggtgggtccgtcaggtagaagtcagacaatggatgggatggctggtcacttcccttttcactgatgtccccagtgaatattaatggaataaaaccatattaactacagagggacagaaaagaagactagctcatcaaggtatttaaggaccaggaactttatttggggggaaagtgaagacacttttaaatggaaagccctaaagcacatacaacagctgacagagtggccactgtgcacatgaaggctgaggagacggatggcagcgtccgttcctccaagatgtccctgggtgtgtgatggttggactccttatgcatatgaatataagagctggactcagggagaaaaaagggccatatctcataggaaaggaagcccaaaaaagcagatgggcatccctggagagagctcattagatttggtgtgtttaagacaaaaatttcttccaaaaattgtaatgttctaagctaaatatgaacctcttcaataaactgagaattaacaggagaatagagctatgagttgagagaagaaacaaatcatgagagagcagaaagcaaatccacaaaaaactgtcatatgacagaagtcagaatggagctggggcagctacttcattattctgaagacttgttgaccatgtggagaaggggcttgaacaaatggggacgttctccaaccttctgaatcagcctccttcttatgcatgagtaaaaatcatagttctgggtgtgaccttcccaaatttcctgtctgtacctcttcccccaggggtagagtgtcttcccaccacaatggtttctcaccagtgtcctcagcttctcctccattgaacttaccctgcagattaagaatttcttctagatgtagttctttgggaattttctgttttctttagtttctgttgactccaccacaccccataggtcacaggtttgattgatttcccctggagacagtggaggtggatccaggcgttcaacagtcctcgctgttcctcccttcctgtcagcaccacaggacagcagataagggagttgactgtagatttttcgaattcttgggaaaatcctgcaaggactagtagattcacactccaataccattagcacatgcatccaaaaaaaatactcacgaaatatttccaggttagcctgttcctctctcaatgccatccagtggcacctgccctgggttcaccaacatgtgggccccactcctctctgctggcatctctctcctcacatttcagtcttctcgttagctctgtgaaagcaactcagatatgttaaaaggttttcttcttcatttattcagtttttcaggtttgttgttaatgaggtcagaataagaccatagttttctcatttttcacattcccacactgagtagccactttctatataaaagccagaaactaagggaacaaatcaaatatccatatccactacaggtgaacgttaaacaatttgacatatgattatgaactaaagtacaatgcagaattagaatcaaggcatcctcattctcataaaagcatgtctacattctcaaataactctgctgagtgaaagtagctgaagaattaagagtgcaattcataaacttctaattgtataaactgcaaaaggtccaactattctaaagtaacagagcagatttgaaatttgtgagaaacgggtgttgaaagtaattggctggtgagatgaaattacagagaagtgacagaaagatttaggggttaacttaattgtacacaacctgattaaagtttgcacacatacgttaccattttccaaattgtgcagtgtagatttgaattaattattaattgtacttaaaaaaagcagtaacaaataaacacatgaatatgtttactgaggaggaacaaaaaatagatgggtatgaacactggaaacatctcagactcttgaaagtacacaggcttgaacactggttctctccgtatacttccggtaaacggctgaatacactaaaagaaaacagagatgtcctggcaggggtggaatcctgcagacctcactaggtgtgtcccacactgccctggagttgtctcaggggagcagtctcctctagtggtcagaggcacaggctgagataatggggttaactctgtccagctgtgtgactttgaatgcattgtataaacactctgttctgtatgtaatttatcttccttaaaatgcaacattgacacttacattaaatgtattctacaaatatgtcaaaaagaagatgatgactgctaaatgattatcaaggcacaatcacataatataatgatattttcctgagtgataagatgactaccaatctcgggggcactttgtctgctctgagccctgcccctcctcaggattcccatcccagagcttgctatacagtaggagacatgcaaataggtttctccctctgctgatgaccagtcctgaccccatagctctgggagagaagcgccagccctgggattcccaggggtttccatttggtgatcaggactaaagacagaggacccaccatggagcttgggctgagctgggttttcactgttgctgttttaaaaggtgaactagagagattgagtgtgaatggatacacttgagagaaacagtggatatgtctggaactttctgaccaggacacctacaagtttgcaggtgtccagtgtgaggtacagctggtggagtctgaagaaaaccaaagacaacttgggggatccctgagactctcctgtgcagactctggattaaccttcagtagctactgaatgagctcagattcccaggctccagggaaggggctggagtgagtagtagatatatagtaggatagaagtcagctatgttatgcacaatctgtgaagagcagattcaccatctccaaagaaaatgccaagaactcactctgtttgcaaatgaacagtctgagagcagagggcacggccgtgtattactgtatgtgagtcaccaggtaagaagacatcagtgtgaacacagacacagaatttcctgaaataagggaggagtctgggctaaaagggcactcaggacccacagaaaacaggggaagctctagggcaggtgcagatggtcatcatgggctgctttccttgagggtctgaggcttcctctgcatctaacagtttccctgggagcctctggacatttatgcttctgtggccacccctgaggtctctggacattctcatttgttgcaaaggcagatgtaagtattggaggcataaaaatgcacaggaggccagggagtctgtagacattgttaccccagaaggtcaatctcaccactagtgctggaggagggtgggagtttgatgaagctgccctaagtatcctgtggtctaagctaagtccaacgaggccatttgtgcctccctgagcacagttatccatcagagatgtcccatgtgtcccagcagcagccatgtctcagtgtcttcactgtgcacagccagtgtctgggaggagctcccaggatgggtgtctttggcacacaccaggtggcgggtgttagagtgcggtgcagcagctggctgcctgttctattgggctccctgatgctggagagatgggaggtgcattctcaggtccagcaccctgtttgtgaatttttatataaaaaccatgattttacttcattttctcagatgacatagataattaggaacagaacctgcaaagaaattgtaattttcaactttaccccaaatttattgtttcttaattctgtgtaagatccagacatattattgccttcctcatgagaaattgttctatttaaaatgaaattagttttttctcacattctttgtttctgttcaagtacagagatcttgattaaagtaagttgggttctttccacacactaaccctcacctcccccagagaaagagcagagattttcctcactctgagtctaagggaggagctgttcctgcacgattcagagcctgcagagaccccccccgccaggtgcagcttcagtgagtcaggtatttctccttgtgggtgacctccaccgccagtgattgctgctcaggtctaattgtgggttaagcattaggacacccttcaggtgatcacatctcagtcttattctgaaaatcaccatgaacagggatagttcaatgcctattctcctgacattagtttctctttattatttggttccaagtatggagaaaaatgtgacaataaatttgtcagaatctaacctcagaatccactgcattactctaggatactcacaaattgaacacaaatgagctctttattctcataaaagtatacgtatttgggaatttcaatgtgttctccagaacctgtgcatgccaacaactgtgtttctcagtgcccacttggcctggtgaagccctcacagaccctctccctcacctgtgctgtctctggattccccatcacaaccagtgcttcctgctgtagctgcattcataaaccccccaggaagggactggagtgaatccagtgcacaggtcatgagggagtgcacattccaacccactcctcaagagtccagtcaccatctccagatccatgtccaaaaagcagttcttcctacagccgagctaagtgagtcacaagcacacagccatgtatttttaacaaaagacacagtaaggtaaccacagtgggaactcacacccaaacctccctgtgggggtgcacaggacagccacagttactcaggaccccaggattcctcaggacaccaaggggcactcaaggccattgtagatgccctcaggtagccaagggttctcaggaaacatggaggaaaaccaggaccccaaaaggtgctccgtacagcaggggactcaggacaattgcggggactcagagcaggctcaaagctcagcttcagggcaggtgcagctggggttgaaaggggctggatgaggggttttgtgacaccatcatatttcaccactagacacactccactttgtctattctaacgcatgtgagtgtatgattagaaaatgatatttatataaatacataaccatagttagctgtgtcaagttgtcctcttgctaggtgtccatagctaggtgcatcagccttgtccataaggactaattccccgcaattactggagaatctcataaattgtggtcaattatgtcagattcctctctttttctgccttcctttctcccttcttctctctctctcacacagaaacttacatacacccaccccacaacacaccaaaatctataacttttattacctgatatattcaataaacctgattaatgtgcagcttttccagcttcgttatttatgctgttgtaacaataagaacaatgtgtttcctagctgtgtacttctctaagctgagtagcatctttgtttataatacctagaattaaaaacaacccaaatgtcaatcaccagcttaattggtaaacaaattgaggaaaagtcattcattgacatactatccactactaccatcaactaatgttgggtacactcaacagcatggttaaattcacaagtacttgtgatgagtaaaatgagccaaagtaacaaaagtgcatacataagatacaactttcataaattctatagaacaaaaagtaatcttaagttacataaaaatcagtagttccactgtgagtattgtaggagaggggaaggactaggaaggaggaattatagtacaagacaaaattttgagggaattgacttgttatctatgttgctcgcgatgatgtctatgacccatttgtaaaattgaacacttcatatggagattattatttttaatttaactccattaatgatagtactaattatagcaggtataatttggtatcaaaagaattagacagagataaataaaatacatgaaaagtcagagactcttgaatatacacataaatgagccctgggcatctctgtatttttagagaaatgctagaatatagaaaaataatggcataattttatgtcactaaaaaagtttatcgaactccaccagtcatgtggtattagttcattttcacactggtataaagaactacctgcgactgggtagtttacaaggaaaagagatttagttggctcaccgttcttcatggctggggaggccacaggaaacttacaatcatggtggaaggtgaaggggaaacaaggcacatctcccagggcagcaggagagagagagaggggggaagtgacacatacttttaaacaatcagtggttgttagaactcactcactaccatgagaacaacatggggaaactggacccatgatccaatcacctctcacctggtccctcccctgacatgtggggattacaatttgagatgatactttgatggggatacgaaatcaatctatatcacatgtccagctctgtcctggagttgtttcagggatccagggtgtccggctgatagaaccagtgacaccaagctcacaccctcagctgtagttgacaccacgcaaagccaagagattacaactaagatttagtttgaatgtcgtgtctgatgaagtcacacactcagagaaagtgaatatggaaaagtttattatttgcactctataggtgtctggtgagtgcagggcaggtctcccaggaaaatctgaaacagcttgaaagaagaggaaaggagactggctcagcatttttatgatggtttggtcctgggggcagagtgaggcttcccactcacagaaaggggtttgcagggtttgaaactccccctggcatcgaatgaagaagctcctgtgatttcaaactagagccaccttgtgtggcaaaaaaggagatgatggaggaatatgctttaaatcatcagcagtcacgcacccaaaaatagtgtgacaacttattctatgcagcaggaataaaaataattaataagaaagaagataagggttcagtgtgggtggacaacacgcaggtctacagaaatgagatgactttagaaatataagcaaaggataatgaaaaaaaggaggggaaggggaattaaacagggtcctggtctgatgtcttgggtagaagcttctcacaatcaaggactaccagctcattctgcaggtcttaggtcagccatctgcttaaaaacatcagaaacgccagagaatctatgaacatggtcagtttaacatttcctatttgagtagctttacagttgtgtggaattcttaactggttcttgttttttcttttagatacaggctctcaccctgtcacacagtttaaagtgcagtggtgtgatcatagctcgctgtaattttgaactcctgactcatattcttcccatcttagcctcttgaatatctagaactagaggggcatgccactcatcccctccttattttttattttattttttcatataaataaggtctctttgtgttgcccaggctggttttgattgcctggtctcatgggatttccctcacttcccttctgaaagtggtgtgattatacagatgatccagtgcatctggcctgaattgattctttaattgtaaaatacgaacccaataattaacttcctgaatgttttctgcagtgagttagttaaaaggatctgacaagattccttccaatatgattcaagagcagtattgtccactgatgttccttccagtttccttgttgaagatcacaagagtctgtggaaaagaggtagtaaaaaggccgcctcaaactcttcgtggttggagtgggtaccacacatgcaagcagtaggacaaggatgatctctggggtaaagtctataaacatataggccttttagctgccaagtcatagggtaataactgatgcagcctgaggagtggaccatggtttcatagtgctagtgggagaacccttggccaagcaagttttacattttattacattttattaaagatttgataattttaatgtaaagatgacattttttaaacattcccagaagattgtgagtggtattgattctgtctcgtatgaacaatgacagtgccctccacggttagattatgttataaactagaatgaggtagagtgtttggtgtgttaaatcactatttttttagcttctatgttagttttttgtttgtgtgttagcatttgctttaaaattctattaatcagatctctagttggtagaaattcatctgaaagtttcttccattgttgtccattttgataggatttccagaagatgtaagaaccctctctgtttgcaaaaatattccaaagttgtgcaccatctagaaacatagttacttaattctaatttttaatttattaaaaagttgtgataagtgcaaagttttctgccttctgaattgatttcataacacacagaataatatatactaaatggaagtttgtactagtaatacaaattactgattaataacctctacttttattattgaggtattatccatcaatatataatcttaaatcaatgatctcagtgggaatcttacctaagtaatatacaaaatattttcctgatctcgacacaaaatagatgtgaacacattcttcatattcagccatgtctcctgtctatcacattatgaaccacatgctaactttgatttacttgggacttgctctaaattcaaactagttatcttttatcttcacgcagctggattattatgtgtggctattttatcagagtgataagatacaatactaacaattttcactgcaggcatgtctaggcaagccccctgtgcacaatgaccttggtgggttggacattctatggggactctcccctgtctgcctaggagagttatctgcctcctccctctatcattttcctctttgaataagtgcatctaactgccgttagaatacagacaaaggccaaccttaactgcttccagctgacaggggatgctgtttcgggaagatctcccttgaggtctgtctaagggacccagtaaaagggagccattatcccaggcttcacttggatgaccatttggagttgatgcctgaaggtgagaagagacaaaccgggttattagaagacatgtatcaaaaccaaacaaggtggtaaggacagtttgaaaaaaaattccaaggctgctgacacacccagatatctggtggctgtagttatgcctgctaagatttgggtgcatggggcttggctttcgttagctcccttggacttattttcccaaacaaagaaacctccgggttagggggaccctatttattccagtcacctggcatgatttgccggataattgctcagaattaaaatattcgtccagatgtttatatagcccatgcctgtgtttcttctgagctgcagccagagatcattggttggttcacagcgataagcagagttagtctaaaatggaggcaaatacttaaaacttatttcttctctcagttaatggattctatagagaaaagtagctactcagcatgggaatgtaaaaaaatgagtaaactatgatcttattctgaactcattaacaacaaacctgaaaaaccaattgaagagactgtaatttaaagacaagtgtatgatatgttttgaaacataatttttctctctccagttctgatttttgtcagaaactaatcattataggactgagttgtttgcaaaataaactttagtcttatggttggtctgatcatttgcataaagtgaagccataataattaataataattctgtaggaaaagcctgcaagcatgaggagcttcacagtctaacactatgagcacatgcatcctccagcaactcactgaatattttcaagtcagccggttcttagcttaaataacatccagttggtatctgtcccaggaacactaatatatggttctctctgcaggcccctttctccacagattaagggttttttttttttctctgtaatatcaactcagatatgttgaatgctttttccttattagtggtttttcaggtttgttgttaatgatttcagaataagatcattgtttactcattttttttaaattcccgtgccgagtagctacttttctctatagaatccattaactgggagaaaaaataacattttcttatgggtgaacaattaaatagtttgacatatatttatgtactggtatataatgcagcttgaaatcaaggcatgcctcaatcataaaaatcatggctaaattctcaaagaattgtgctgagtgaaagaagctaaggaattaagagtaaattttatataattcattgtagaaatattagaagatgccactaccataaattaaaatgaagaagacttaaatttttctgagaaaatggtgttgggaatgatgcggatgtgatttaagtttcagaggaataagaaaaaagatttagggattaatttaattattcaaaacttgattgaagtgccgagtgaatggctccaaacatagtctacatttttcaaatcattccctataaatttgaattaattatttatttttatacttgaataaagcaataacaaagaaataaatgaatatttttgctaaaatggagcaataaaaagactgatattgacagaagaaatatgactgacttctgaaaatacacacacatgagccgtggttctctctacatatttagataaattacagaaagttgtcataactgatggggaatcctgcagacttcactaggcatagtccacactgccctggagttgtctcaggggagctgcctcctccagtggttagagcacaggcccaggtaataggactcatttttttagatgtgtaattttagacacactgcacaactgctgtgttctctgtgcaaattatctcctgtaaaatgtaacattgaaacctgccttaaatatattgtgtaaatatgtaaaaataaaatcagattgtgagagctaaatgctaatcaaggcgcaatcacgtaatatacaattatattttcctgaatgatggaattaataccaatctcccccaggacacttcatctgcacggagcccggcctctcctcagatgtcccaccccagagcttgctatatagtcggggacatccaaatagggccctccctctgctgatgaaaaccagcccagctgaccctgcagctctgggagaggagcccagcactgggattccgaggtgtttccattcggtgatcagcactgaacacagaggactcaccatggagttttggctgagctgggttttccttgttgctattttaaaaggtgattcatggagaactagagatattgagtgtgagtgaacacgagtgagagaaacagtggatatgtgtggcagtttctaaccaatgtctctgtgtttgcaggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagacacagtgaggggaagtcattgtgcgcccagacacaaacctccctgcaggaacgctggggggaaatcagcggcagggggcgctcaggagccactgatcagagtcagccccggaggcaggtgcagatggaggctgatttcctgtcaggatgtgggactttgtcttcttctgacggttccccagggaacctctctaagtttagcattctgtgcctatgaacgtcttctctaagtatttgaaagagattattttaatatgaagagcagttctcactcgcccaaaatgtggattgatgcttactgggatgaaaagtccccaaacatggtcaccccgataagagtctgagtgagctcagggcttcctgctgagtctcctcctatcagaccaaggacagggacctcagtgaggttcccccgtcaagaacagtctttatggatactgattgtgggcggcaacccacccaggtgccgacgcaagagaccgaggacacgagctgttccagtacaataaaatataaaacaagaatagttataccagatatagatcttagatatgattatatatgaatatcattaatcattagttggtagcaattactctttattccaatattataataatcctcactctacaatcataacctaggaaaagccaggccatacagagataggagctgaggggacatagtgagaagtgaccagaagacaagagtgcgagccttctgttatgcctggacagggcgaccagagggctccttggtctagcagtaatgccagcatctgggaagacgcctgttgccaagcggaccatggtctagtggtagactcagtgtcaaggaaaaacacctgctacttagcagaccaggaaagggagtctccctttccccggggagtttagagaagactctgctcctccacctcctgtggagggcctgatatcagtcagacccgcccgcacttatccggaggcctaacagtctccctgtgatgctgtgcttcagtggccacactcctagtccgccttcgtgttccatcctgtacacctggctctgccttctagatagcagtagcaaatcagtgaaagtactaacagtctctgataagcagaaataatattgtaagctgtttctctccttctcctctctctctctgcctcagctgccaggcaggaaagggccccctgtccagtggacacgtgacccatgtgaccttacctatcattggagatggctcacactccttaccctgtccctttgtcttatatccaattaatatcagcgcagcctggcattcagggccactactagtctccgcatcttggtggtagtggtcccccgggcccagctgtcttttcttttatctctttgtcttgtgtctttatttctatgctctctcgtctccgcacacggggagaaacccactgaccctgtggggctggtccctacactgatcacagacaatagagggtaggccaggatcagtgtcatgtaggacatcacaggtttcacctctgaaccttttcctgacactaaatatgcaaatcagcatcagcactgatctggtgattcttttgttcctaatccatttacttcctttttcagtcgttgttttcatttttccatttgcttttcctgctttctgcaaaaggaagatttttccctgtggtcaaaattccggacctcaagccctttcctggcgctcaggtgggtctcaggctgtggctgctgcagtcacgcgggagaggctggtgggactttcttcactcctcgtcactcagggccctccactgtgttgcatggagacttatctggaaatgcaagttgcgactgagaactgaaggggacaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgatgcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctctagagtcgacctgcaggcatgc

SEQ ID NO: 112 - DNA, 218622 bp, Artificial Sequence
  Description of Artificial Sequence: Synthetic polynucleotide
cgtacgaatacagacaaaggccaaccttaactgcttccagctgacaggggatgctgtttcgggaagatctcccttgaggtctgtctaagggacccagtaaaagggagccattatcccaggcttcacttggatgaccatttggagttgatgcctgaaggtgagaagagacaaaccgggttattagaagacatgtatcaaaaccaaacaaggtggtaaggacagtttgaaaaaaaattccaaggctgctgacacacccagatatctggtggctgtagttatgcctgctaagatttgggtgcatggggcttggctttcgttagctcccttggacttattttcccaaacaaagaaacctccgggttagggggaccctatttattccagtcacctggcatgatttgccggataattgctcagaattaaaatattcgtccagatgtttatatagcccatgcctgtgtttcttctgagctgcagccagagatcattggttggttcacagcgataagcagagttagtctaaaatggaggcaaatacttaaaacttatttcttctctcagttaatggattctatagagaaaagtagctactcagcatgggaatgtaaaaaaatgagtaaactatgatcttattctgaactcattaacaacaaacctgaaaaaccaattgaagagactgtaatttaaagacaagtgtatgatatgttttgaaacataatttttctctctccagttctgatttttgtcagaaactaatcattataggactgagttgtttgcaaaataaactttagtcttatggttggtctgatcatttgcataaagtgaagccataataattaataataattctgtaggaaaagcctgcaagcatgaggagcttcacagtctaacactatgagcacatgcatcctccagcaactcactgaatattttcaagtcagccggttcttagcttaaataacatccagttggtatctgtcccaggaacactaatatatggttctctctgcaggcccctttctccacagattaagggttttttttttttctctgtaatatcaactcagatatgttgaatgctttttccttattagtggtttttcaggtttgttgttaatgatttcagaataagatcattgtttactcattttttttaaattcccgtgccgagtagctacttttctctatagaatccattaactgggagaaaaaataacattttcttatgggtgaacaattaaatagtttgacatatatttatgtactggtatataatgcagcttgaaatcaaggcatgcctcaatcataaaaatcatggctaaattctcaaagaattgtgctgagtgaaagaagctaaggaattaagagtaaattttatataattcattgtagaaatattagaagatgccactaccataaattaaaatgaagaagacttaaatttttctgagaaaatggtgttgggaatgatgcggatgtgatttaagtttcagaggaataagaaaaaagatttagggattaatttaattattcaaaacttgattgaagtgccgagtgaatggctccaaacatagtctacatttttcaaatcattccctataaatttgaattaattatttatttttatacttgaataaagcaataacaaagaaataaatgaatatttttgctaaaatggagcaataaaaagactgatattgacagaagaaatatgactgacttctgaaaatacacacacatgagccgtggttctctctacatatttagataaattacagaaagttgtcataactgatggggaatcctgcagacttcactaggcatagtccacactgccctggagttgtctcaggggagctgcctcctccagtggttagagcacaggcccaggtaataggactcatttttttagatgtgtaattttagacacactgcacaactgctgtgttctctgtgcaaattatctcctgtaaaatgtaacattgaaacctgccttaaatatattgtgtaaatatgtaaaaataaaatcagattgtgagagctaaatgctaatcaaggcgcaatcacgtaatatacaattatattttcctgaatgatggaattaataccaatctcccccaggacacttcatctgcacggagcccggcctctcctcagatgtcccaccccagagcttgctatatagtcggggacatccaaatagggccctccctctgctgatgaaaaccagcccagctgaccctgcagctctgggagaggagcccagcactgggattccgaggtgtttccattcggtgatcagcactgaacacagaggactcaccatggagttttggctgagctgggttttccttgttgctattttaaaaggtgattcatggagaactagagatattgagtgtgagtgaacacgagtgagagaaacagtggatatgtgtggcagtttctaaccaatgtctctgtgtttgcaggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagacacagtgaggggaagtcattgtgcgcccagacacaaacctccctgcaggaacgctggggggaaatcagcggcagggggcgctcaggagccactgatcagagtcagccccggaggcaggtgcagatggaggctgatttcctgtcaggatgtgggactttgtcttcttctgacggttccccagggaacctctctaagtttagcattctgtgcctatgaacgtcttctctaagtatttgaaagagattattttaatatgaagagcagttctcactcgcccaaaatgtggattgatgcttactgggatgaaaagtccccaaacatggtcaccccgataagagtctgagtgagctcagggcttcctgctgagtctcctcctatcagaccaaggacagggacctcagtgaggttcccccgtcaagaacagtctttatggatactgattgtgggcggcaacccacccaggtgccgacgcaagagaccgaggacacgagctgttccagtacaataaaatataaaacaagaatagttataccagatatagatcttagatatgattatatatgaatatcattaatcattagttggtagcaattactctttattccaatattataataatcctcactctacaatcataacctaggaaaagccaggccatacagagataggagctgaggggacatagtgagaagtgaccagaagacaagagtgcgagccttctgttatgcctggacagggcgaccagagggctccttggtctagcagtaatgccagcatctgggaagacgcctgttgccaagcggaccatggtctagtggtagactcagtgtcaaggaaaaacacctgctacttagcagaccaggaaagggagtctccctttccccggggagtttagagaagactctgctcctccacctcctgtggagggcctgatatcagtcagacccgcccgcacttatccggaggcctaacagtctccctgtgatgctgtgcttcagtggccacactcctagtccgccttcgtgttccatcctgtacacctggctctgccttctagatagcagtagcaaatcagtgaaagtactaacagtctctgataagcagaaataatattgtaagctgtttctctccttctcctctctctctctgcctcagctgccaggcaggaaagggccccctgtccagtggacacgtgacccatgtgaccttacctatcattggagatggctcacactccttaccctgtccctttgtcttatatccaattaatatcagcgcagcctggcattcagggccactactagtctccgcatcttggtggtagtggtcccccgggcccagctgtcttttcttttatctctttgtcttgtgtctttatttctatgctctctcgtctccgcacacggggagaaacccactgaccctgtggggctggtccctacactgatcacagacaatagagggtaggccaggatcagtgtcatgtaggacatcacaggtttcacctctgaaccttttcctgacactaaatatgcaaatcagcatcagcactgatctggtgattcttttgttcctaatccatttacttcctttttcagtcgttgttttcatttttccatttgcttttcctgctttctgcaaaaggaagatttttccctgtggtcaaaattccggacctcaagccctttcctggcgctcaggtgggtctcaggctgtggctgctgcagtcacgcgggagaggctggtgggactttcttcactcctcgtcactcagggccctccactgtgttgcatggagacttatctggaaatgcaagttgcgactgagaactgaaggggacaagcttgtttggttaacatgggatgtggatgtgtttctaattttgttctgataaactttcacagagtaactttctgcactagtcatgtgaggaagaggatgtgaacgtagtcagaataaaaatagaacaacttgtgttataatctttacaggtgaagctggagaaggtcatgaatagagggttctcatgcacacatccctgataacaagaactaccataaaattactctgcacaaccacaactttcaacaaaggctaccacaacaataagagaattaatattgtgaggatatctgccctgcaactcccagtacaatcttaaactgattccacccttgttattaattcttctacccccaggataattgcctcagaacagctcatgtaagtcctctcatttatcccttaaaacaacctttaccaacctttactaacctgacttcctttacctacctaaatatgcccagggataatcccactggaatgctcattttcaaatacatattatttgattttggagaatttctttctgtctgatattcaggtgtgacaagctgtagagggtcacaccactttcctgtgagatgtaggggatgacaatttggggggatggctggaaacatccaatatcctcagggtcggccatcagtaagcgcaggctggaagtctcagaacgagttgaagttgcttaaccacggaattttaccttctccagatcagctttgatggaatcagggccaaactggttatcaatgataatctacctaacattgagtcaactgatcacagttttaataacctctattaaaaattcacaccaacacttggattagtgtctgatcaaataactacaaagtattttccagccaagtataccataaaacagaccattacccatggagaaaaacatttaacatgagttctaggtccttacattgttaaaggtgtaaaactgattatttttaaattatgctttttatttttgctattgagttgtagaagtttcatttacattttggatattaacgcttttttcagatacatgatatattatccaattctgtgagttggaattatttcattgctttgcagaatatttttttaatctagtccaacttgttcaattctgcttttttttaaatgtgctttgaatgtaaaatccagaaaaagattgctaatttttgaggattgggagttttacagttgcaggaatttcattgaaatatttaatgcatttaaagttaatttttgtgtttattctaacctaaaattcttaattcttcacatgtgaaaatccagttttcataacatgctctttggaagacaccataatttagccattgtatgttgatggttctcatgctgaaaatcagttcgccatcaaaatgtgggtttatatctaagctctctatatgcatttatgctgaaaccattcggatttattactctgtgtttgtaacaaatgttgaggactggaagtgaaatgcctcaagctttattcttgccttattacagatattagacccaaatattctaaccttctactagtgagtataataatagctgtcgctttttttttttttttttgattcagagtttcactcttgttgtgtaggctggagtgcagtggtgtgatctcagctcaccgcaacctctgcctcccgggttcaagcgattctcctgcctcggcctcccgagtagctgggattacaggcatgcaccaccacacccggctaattttgtattttcagtaaagatggggtttctccatgttggtcaggctggtcgcgaactccagacctcaggtgatcctcccgcctcagcctcccaaagtgctgggattacaagcatgagccactgcacccagcctcttcattttttttttattcatatgttcattcagcagccactatgtcttcccattgatttctttggtttcctctttactatctttttctttttagtaaagctgttactcctaagggaagatgggaggtgggcctggacagggatttggtgcattcctctcttcactcacagttcttattgatctctccagtgtctctagaacactggttttcctggcattaccgctgcagataatttctcttgcaatgtagtgctgatgaggaggtgtgtctggatgcatttcagctatagttgctgttttgctttccctgacacaaccgtcccaaggggtagaggctggagcattttgtgatgtgtccccagtactgaagaaaaagccttcaatagcaggaggaattcctcaactgtatacactctgagaatttaaacaataacttctctatcacactcaaatttaaaccatccaatgaatatgtctactttaatcgtgtgttaacttaaatgatatttggcagcctctgtcccagaaaagattatcatctgctcctgtttatttccctgcaagtctttatctctcttcagatttcagatatcttgtttgtcttataacatcaaaaatctgatgaatttaagaaaatgtgctaatttgcagatcagtaagctttagtagttgtgagaataataacaaatttttatgggatgcctgcatctccaagctgagtagcatctttatttctaacactcagaaactagaaacaatgcaaatatcaagaagatatatagataaagagtaatggcatgctaatttacggtaatcatagccatcactagaatcaatacactgttgatgctcaatgtggttgaatcacaagtagttataatgagtgagaagccacacacataaaacacatactatataattcctgtataataaattcttgaaactcaaaaccaaagtattcaatatgaaggattgactcagaatatggcaagggaaaaaaataattgggaaggaggaattgtagagtaacacaaggaaacttttaagtgtaatttatttgtttgttatctggatggtttttggggatgcacaggtgagcacgagtggaattacattttgttgtgtttgtttttttctgaagagatgtggtcctactctgtgacccaggcaggactgcagtggtgggatcatagttcaatgtagcttccaacttctggtcaccaacaatcctcctgcatctgccatctaagtagctgaaactacagttgtgtgccaccaggctcagcttgagtacttattaaatcaaacactttatgcaatatttaatgtatggcaataatgtctcattgagagtattacaaataaatgaatggataatttgttcagtacagattgatggaaaatagacactaacatgaggaatgtctgacatttatgaacatacaactgcataaaatgtgttctcttacattcattaggtaaacacaatagtgcatacacatcaaaccatgctttcattacaggaaggaagttctgaaaatgtcactgggggtgacccacgctgtgctgggcttggttcgggggcagtcaggcccggtggtgagaagcacaggcccagatacccaggcttactctgcaaatgtgagctctggggacattgtaccacccatctgtgcttctgctggtaattttccatctgtaacgtggaaataacattgatactacataccgtgatttctccacatatgtaaaaataaaataagatgattgctgctaagtttaaataagggcagttttcataggtccattgtacctcaataaaattactttaaaataaaaattacaaatacagttgtaggtttaaagagtttatcacagaacaaacttataataagaaactatattttcaaaaattgtatcaatatctctaaactcccccaggacacactcacctgctctgggctctccactctcctcaggattcccaccccagagcttgctatatagtaggagacatgcaaacagagccaaacctctgctgatgaaaagcagcccagccctgaccctgcagctctgggagaggagccccagctccaggattcccaggtctttccatttagtcttcagggctgagcacagaggactcaccatggagtctgggctgagctgggttttccttgttgctattttgaaaggtgattcatggggaatgagttgaatgtaagtgaatatgagtgagagaaacagtggatgtgtgcggcagtttctgaccagggtgtctctgtgtttgcaggtgtccagtgtgaggtgcagctggtggagtctgggtgaggcttggtacagcctggagggtccctgagactctcctgtgcagcctctggattcaccttcagtagctcctggatgcactgggtctgccaggctccggagaaggggctggagtgggtggccgacataaagtgtgacggaagtgagaaatactatgtagactctgtgaagggccgattgaccatctccagagacaatgccaagaactccctctatctgcaagtgaacagcctgagagctgaggacatgaccgtgtattactgtgtgagaggcacagtgaggggaggtcagtgtgagcccagacacaaacctcctgcaggggcatctggagccacaagggggcgctcaggatacacagaggacaggggcagccccagggcaggtgcaggtggaggtcaagggctgctctccttcagggtctgtggcttcctctcatctaacagttccgcagggagcctcttgtatttacagtgatgtgctactgaggtttctaagtttgtaaagtttattactacaggaggaaccactatcaaacgcccttaaggcaggtgtcactaatggagaaaggaaagtgcacaggaggctgggtgaggctgtggacactgtctgcctatgattcaagtttcacaagcagtgacggagaaatgggagtttgatggagctccctaactaccatgtggtctaaactaagtccaactaagtccctgagctctgggtgcccatcagggatccgccatgtgcccggcagccgcgtgcctttttgtctcctctgcgcccaatcactgtctgtgatgagcttccaggatgtgtgtgtttggcacaaaccaggtgatggacgtcagacagcagcagctggtgcccggatcatgggctccctaatgctggaggaatgagaggtgcattctcagggacaagacattgttgatggatttttatgtagaaaccacgattttacttgcttctctcaggagacatagaagaagcaaccatgcagtcagcaaataattataatttccacaattaccccaaatggttaatccttaattctgcgcagggtcccaccgtagagtcacctttctcatgaggaatggttgaatctagaatgagtccacatgattttcatatttttggcttctgtccatgttcagagagttagagtagagtaagtttggacctttccacacactaagcctcacctcccccacagaaagagcagagacttcaactattcctgagtgtggggtaggggctggtcctgcacacctcagagcctgcagagactgccacgtgcagtgttatagacttgggtgttttctcattcaggaggggtgacctccacggcctccgatttctgctaagatataactgtgagtgcagaattaggacactattaggctatcatgcctcacttctattctgaaaatcaccctctttatagtaaaagaaaacaattcaatgtccatgcccctgaaagtcatttctttttaatttggttgcgagtttaccacatagtgcctgaatttattctcagaatctactgaattgtttataaatctcacaaattgaacaaaagtgaattcttcattcttactaaaatgtgtgtatgtaggaatttcagtgtgttttccagaagccatgcacaccaaccactgtgtttcatggtcatttattggcctggtgaggccctcacagaccccctccctcacctgtgctgtctctggattctccatcacaactagtgcttcctgctggagctggatccgccagtcctcagtcaagggagtggatcagggcataggtcacgagggagcacaaattctaacccactcctcatgagctcagtcaccatctccagatccacgtccaagaaccaaattttcttttagctgagttctgtgaccaacaatgccacaaccttgtattactgtgagaggaacagaagagatgtcagtgtgatcccagacacaaacttccctggagaggggcccaggaccaccaaagagcactcaggcccatgaaaacagggcccaagctggagaacgggtttcctgtcaccctcacctttcaccattagatactctacactatgcctatgctgaggtgtgtgtttaatataattagaaaatggtatttatatacgtgtataatcatatctagtgtaagaatttgtagtttccaccttatgtgaccattaaagacaacatctctcacgttattcaaggaccttataaagtataatacttttacataagatttatctccttttgtgtgtttctccttctgtctatattctctctctctcttcctccctctttctctctctctctccatctctctctctctgtctctctctcacacacaaatacacacacatgcaatcggtgacagtatataggctaattaagaatatattcccatatgatttaaaaataacagttttacaaatatttgcctttaatttttcaaagaaaattaaatccaaatgccagtgattttttatgtgacttttaaaatttaaattgttaatttgtgttttcatcaatgcttgtatgtgtgcttgtgtattctcacagattatgtggtgccttcacagaattaaacatgtgaaactctccacttgaatttctgtgactcaggactggtgagcaaaaagttagaagtcactctcctgatccttccctacagctgcagattcctgaaggtaatgacctcacagtagaccaaggccctcaaaggtgaccttgagttccagcacatcttgggaggccaagcggatgtttgtgaaagaaatagtggctatgtgacagtttctaaccagaatatctctgtgttttcaggtatccagggtgaggcccagcttacagagtctgggggagacttggtacactgagaggggcccctgaggctctcctgtgcagcctcttggttcaccttcagtatctatgagattcactgggtttgccaggcctcagggaaggggctggaatgggttgcagttatatggcgtagtgaaagtcatcaatacaatgcagactatgttaggggcagactcaccacttccagagacaacaccaagtacatgctgtacatgcaaatgaacagcctgagaacccagaacatggcagcatttaactgtgcaggaaacatcgtgatgggaagtccacgtgggctcagagacagactgccatgcaggacacagggggtggcttggctgaagggggcactcagcacccacagaagacaggagcagcccagggcaggggcaggtggagttcaagggctgctttcctgtcaggttctgtggcttcttctgcatcaaatgcgttctcctgggagcctctctatatttatggttctctgcctaccactgaggcctctggattggaaaagattactactagaaaaaaaaattctcatatacccctgaagaatacatcattaattgaggcagaagatgtcacaggaggccagggaggctgtggaaactgtgcgacgtggatgcacatctgacaacaaagacatgaaaaatcagggaacactgataaaacctcctaattatgccatggccctctctaagcctagtaaagccattgatgccttcctgggccaaacccacccatcaggggatcactcctgtgtcccagcagcagacatgccttagaatctccactgtatgtaatcactgtctgggaggagctcccagggcatgtgtctttgcattaaccaggtgatgggtgtcagagaacagcagctggatgcctggtctatgggttccctgatgttgaagaaatgggaggtgcagtctcagagccaatacactgtttatgcatttttatatagaaaccatgatttttcttgcttctctcagatgacatagaggatcaagaaaacagtctgtaaacaattgtaatgtccccatttcttctgaataaatgcattatttcttaattctgagtgggggtttgtcagaccatgcccttctcctaagcaattgttcaatccaggctgaaaccacatggggatcacatactttggtttggttcaggtgcagaggtcttcagtagagcaaatttggtccttcccacacagtaagcctcaccttcctcagagaaagagctgagattgatccaactttgtctgaggtgggagctgcttctccacaccttggagcttgcagagacccctaaatgcagctttattgagtcaggtgtgtctccatgtgggggacttctgctgctagtgatctctgctcagttctaaatgtgggttcagaattaggacacttaggttatcacgcctcaaaaattaccatcattgtagatagaaataatagtacaatgccaattgttgtcacttgtttcttattattattggagtataagtttgaagagacaaattgttaccatatatttgcataaatctaatgtcagaatctcttgaattgctcttgaacacttacaaactggttagaagcagattcttatttttttctatactagtgtattttgggatgtcaacattttgtccagaacatgtgagtaccaataactgtgtgtttcagaaatgactgtgagattcagtcatttctatcgagtgggaaaaccagttaactttgtctttgatatatggatggaagcccaagatagaggcttgtcagtcattgtttctgtgccttctcccttgggaatgtctgtatttttttatgctctgtcctgggtctataccccaatggttcccctactccatggcacctgcctgtgcctgtgcatgcccctgcccacactctccgtgaaacatctgctttggctcaggaagaacccctcctctgccttttttcctcctgcccctggtccacattcttctccatccacaggctctcagcagcacctcccatccacactaaccctacatggggtcataccttgtccaccacttcctctctcttttcttctgagctttgccttttattccaacagcctgtttccatctcacctggacttgtgtacaggaaaggatttaccgagcagtcttgggttgtgcaaaccctgaacattcctgaaaaagtgctttctcaagctaggcccatattcagctcctgggagatgatatctgcctttttggcatactcctcctggtagtattattaaaccacttgattaagataaggtttacatctgtaaaactacacattatttaacatacttaactcattgagtttggagtaagtatacatctgcaaagttatccccatcatcaaggtcataaccatagaaatcacttccaaaacattcctcttatctctcttaatattgtgattattttattagttaaaatgtatttttgtttgtgtttgtctgtgtctctgtgtgtgtagcctgggtgcacgctatactacctgttttcataatgacttatggtgaatgcctattagtgctcaagaggccggcgtctgagcactggaggtcaattgtgcaggtgtcacacacatctgtgatgggcccaataaacagccctgggcacaagcactcaggtgagcttccctggtggacaatgcttcacacatgttgtcatgcatcactgctgggagaactggggacaagagactcctcagggaaagaacacctgggagctcatgcctggattctcagggccttctccctggtgcctttgctcattttaattcatattcattcgctataataaagctgcacccatgagaataacagcttttcttgtgtcctttatttgtactgattaaggggcctgaggatggtcttgggacactcaacacaattacatcagagttggagaatgctagaaagttcctgattgctgacgcatggctagaggattttttataacatcaaaggatgagaaagtgcgggataaaagacattcaatgcccagatggctacagaatcatatggcatgagatggcatgtacactccaataaggagcaggaagtgaaagtaatccatggaatttagaaacaacagatacagcttcctaggagttgttccctgaaaaaggaaaagtaaaaataatgaggaacaacccgaatatgcaattcatatctgtgatagctaaaataatagtaaaaagatgcacatccagccctgcagtgtgccctgtgagccgaggctgctagactcccattcaccaccaaagggtacagttgtccagaaacaacacacaacacataagagtgacacagaaggtagcccagagtttgggctggggagaggaatccactagacaactataacaaggaggacagcatggaaagtggcatcattttgtgatatgattgatatcattaatttatatcatcggattgtgaacaaagttagccaatggactatgagagtgactgacgtagcagcttctctggcttcgtgtgctgcagatgagaggagaatgtttgggaggatgctggacccacagctcacaacagacatatgacagacgtagctgatcccaacctcaagtaggatgttcttgatgagacagcttccctggtgcactggatatcagatcctgtatagtttcagaacttgtgtagtttgtgttgctttggctttttctctggatcttttaggtgctaatgaaatgagagtgcttcacaaaaaaatggggcagacaaaggggatagttaagggcctcctccaagcaatgtggatatcataaaataaatgttaaaaaatgaaagaactaaacaagaaggtgctggggttgacacaaaggacttaaaacagcactaccaggagttgggtgcagcaatgggcatcccttcaggtccatcagcaagtcagagacctaaacaaatattccctattcatgttgaattggcagagtgtaaaaatctagaagacaaaatggccaggaaaaatgtgcgattttgcatgggtgaaggtctggcaagttaatcatcttgaggactgttgaggtcctgaggtggtcctgcccttgcttgatgcccaggccgtagtccaactcacacgaaattgccagggaatagacagtagtttttttagtagttcttgttatcaggcataagtgcatttgaattttctcttcatggcctttcctggcactatttctcattttttttaacacacatagtttcaactagatttatcaccttcacagggtcacagagaagggtggaagaagggaggccctggtatgggtctcgaagaaacatggaaaagagtggagagggacaatagcagggtgtaaggaattattgagaccttactctgcccctcccaggaggctcaggccagcctttttctgcatttgaggttctgggttataaacgctgtagactcctcccttcagggcagggtgacaactatgcaaatgcaagtgggggcctccccacttaaacccagggctcccctccacagtgagtctccctcactgcccagctgggatctcagggcttcattttctgtcctccaccatcatggggtcaaccgccatcctcgccctcctcctggctgttctccaaggtcagtcctgccgagggcttgaggtcacagaggagaacgggtggaaaggagcccctgattcaaattttgtgtctcccccacaggagtctgtgccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacacacagtgagagaaaccagccccgagcccgtctaaaaccctccacaccgcaggtgcagaatgagctgctagagactcactccccaggggcctctctattcatctggggaggaaacactggctgtttgtgtcctcaggagcaagaaccagagaacaatgtgggagggttcccagcccctaaggcaactgtataggggacctgaccatgggaggtggattctctgacggggctcttgtgtgttctacaaggttgttcatggtgtatattagatggttaacatcaaaaggctgcctaacaggcacctctccaatatgacagtattttaattagtgaaaattttacacagttcatcattgcttgcttgccttcctccctcctgtccactctcactcactccttcttttattttctacttaattttacaaaatcatttaacccctttttgaactattaataggttatctttgtttggtgattgttttcctttcaataatatgtactgaataattcatctttgtgccaattcataagtattctggtgtaataaagacttctttcataaaaattggataaattaaaataaagataaatttttaaaaacatacgatctatcaaaactgaaccataaagaaataaaaactctgggttgggtgtgtttgctcattcctgtaatcccagcactttgggaggccatggccggtggatcacctgaggtcaggagttcgatatcggtctggcaaacgtggagaaacgctgtctccactaaaaatacaaaaattagctggacatggtggtgctcgcctgtagtcccagatacttgggagcctaaggccagagaagagattgaacccgggaggcagaggttgaaataagccgaaatctagccactgcattccagactgggcaacagagtgagactccatcccgaaaaaaaaaaactgaacagacctatgagtaaagagattgagtcagtgatttttcaaacatctcaaatcaaagaaaagtcaagaacttcatggcttcactactgaattttatcaaaaatttaaaaaaaaactagaatctctatacaaatttccaacaaaataaagaggaaaaaatacatgcaagcttattttggaaggtcctatttccaaagcaaggaaaagacactccaaataaataaaattacaggctaatatccctgattatctagtttcaaaaactctcaagggtggtgagaaaccaaattcaacagcacattaacaacagaattcaccatgatcaggtgtggtttatctctaggaagcaatgaagtttcaacctgcagaaataaatgtgatatatcaaatgaaaatattgaaggactaaaaccatatgcaccatatgtccatgtcaatagatgcagaaagagcctctgtcgaaatccactacactctaatttttaaaaatctgaacatattatgcataaaacatatatacctcaacataataaagaccacatatcacaagcccacatctaacatcatacacagtgatgaaaattttattttcctctaagactagaaactagacaagatgcttcactatcaccaatattattaaacacagcactgggtggtctagacaaaacaggccagaagaaaaaaatagaagtcatccatatagtaatgaataaatataaaatatatttttacatattacatgctcttatttatacaaagccttaaacactccaccaaaaaagattgaaactaatgaagaaattcaataaagttgcagaatccaaaatcaaacttacatttcaagatggcaggttagaggcattgctagtattcctcttccacttggaaggacaaactgatgtggagagatgaacatcgcggacttattttcaagaagcaatgcaggaactgaacagaaacactgaaataatctacaaactttctgaaaaagcaggaagctgcagcctacactgtgagtcaggtgaagggctgggagtccccagcatttgagggagaacagccaaaaatttcagccagtggtcccaagttgaaagtagctctcaacaggggtgtgtaatataacctagggttgggacgaactcccttggccagggcctgggtagggaagtgttaaaagtggtctctgcaagtttaggagccatgggtgcaggagctggtgccctgctttgcagcagacaggaaggggcatggcatgaaacccatggctgcagtctccatggggacagcctatgactcctggcatttggaggtattgatcacagattgactgaaactcatctcactgctgccagtggaacaccacgggagtggatcagcctcaccaagtatgtgggaactgtgtggggcctaccaccacctgccactccccaccccctgcccaaacttctgtggaggagaggcagccatggtcccatctggaacatcatcccagtggcctgagaaccacccctgtcccccacacccacaggggctgctgcttgccctgcatacagagactcagaggggaaacccacctggcccaaccctcaccttgctttgtgcagccacctgccctggcagcttaacacaaaagacagcatcttttgggagctacatagccacacccactgcctaagaatccatagtagcccccatacctgggcaacacaaggcttgcaaaaatcccaccgctaataatgcagctggtgctcttttgcaagcaccacctcttagctggaggccaaccaactatgcattacagcatctcctagtagactaacactgcatcctggaaggagaaaatgactgtgcgatctcagttatcaccatggcctgcaccactttggatgaccaggagatcctgagtctctccatgtgaccagttcattgctactatacccatcattcaagaaagccagtacacaaaggctatcaatatccatggaatttcacagagtctccttcactctcctgcctgccactcccatcagacccggttctgctgttcactgttgaaaaatatgaggacagttcacatcactggatcacttagagacatttgcccacaccagcctgaagtgtgtcaacgtcactgggcagctagacctagagaagaaacataactcacagtaccatggctcccaggttctcctcctcttaggggaagggagtgcaccacattgagggaacacctcatgggacaagagaatctggatggcaggccttggacaccagatccctccactggtgggaaacttcttctagcagaagtacagttgcagcactgggctcagctgggaaagtcttcagctctttctcaacagacagccctgttgcttgtgaagaatcttgaagaagaggaagcctttcccccttgtacaccactgtaggcacacttggggtctctcccacaagacctcagcatgggtgcaactatagacagcctttctggaacacatcattgtgactgcatcccccagaaacagcactttctggattcaggcttgcatgagacagagagtcacagttcctctctatttggcacatgaacatttgtacagatgaaaaaacatgcctgtcttatctgaatagccggaatactgggacagcagtatgtctgagaggtggataaatttcctactgacttgacaagagagctgaggtggttccaacccttcccaccgataagacctcagtgggactcactaaaacctctttcagccaactctgtcaaggctgggacttaatttacccacctgctttagccacaactagtttctacccaaggaaaagtcctccactgatgtgaagcttgagccatcaagcaaataaataaatcactggggacaaataaaataaacatgtgcatgccacagaggaatgagataaggtttaagagacctctaccattctaaccccatagaagacagtgaacttgctcacagaccgagcagatttctactgcaatcaacacataggaaagccatcatacaaagattctccataaccccggaactcttacagagtcttcacccctctaaggaccaaaaaccaaatcaggttgtaattaattataagcattaaagtctcattcttaagggaaaaaaatccatttaaaaacaaacacaagaaacagtcaaatcaaacataaattcaataataattagaaaatctaccaaaatgagaggaaatgagaaaaataactggggaaaaatgagaaaacagggtgctgtgccagtgccaaaaggtcacaaggtcacactacctctccagcaataaaccataacaaaaatggagtctttgaaatatcagaaaagaaaatcagaatgttgattgataagctactcaagaagatatcagaaaaaggcaaaaatcataataaataaatttataaaactgttgagaatatgaatacaaatttttacagagagatagacatcctaaagagaaaccaatcagaactcctgaaaatttaaaaaaatgcagggaattggaaagggaattacaaaatgccatggaaagtttgaaaaatagactagaaaaaagtagcagaaataacaatagactagaaacagtacaaaataaaagtagaagtaaaatattcgaggaaaaagaaaaaggaaacagttaaagaaaaaagtagaaagaccagactattattgaaataaccaaatcagagaaaaataaatttaaaaagagccaaaagaagtgaaaaaagtctccaggaaatatgggattatgtaaaacaaacaaatttaagaataattggtgctcctgaagaagaaaaaataataataagtttgggaaaacttctctgaaggaataattgagaactacttctctggcctgactaaagacctagatatccaaatccaaaaagttcaaggaactcctggggaattcattgcaaaaataccttcaccaagcatacagtcatcaggctacctaaagtctacatgaaggaaataattctaagagcagtaaaacgaagaaacccatcagaataatggcagacgtctcagcagaaacttgacaagcaagacagattagggttctattttcaaactccttaaacagaaaaactttcaaccaagaattcttttttatcccgccaaactgttttataaataaaaaagaaataaagtcattttcagaaaaacaaatgctgagggaattcatcactatcaaaccagcactacaagaaatgctagaataagttctaaaccttgaaacaaaaggccaatatgcacaaaaatggaacctcttaaaaattaaaaactcacggggcctataaaacaataacacaatatcaaagaataaacaaaattaggtaacgacatgacaaagagaatagcaactcatatctaaatattcacattgaatgtaaatcataaaaggcatggaagaaggaatttcacaaaaatagaaaccaggagtgagcaggactagctatttttgatctcagacaaaacaggacttcaaagcaaaaacaatttaaaaagacatagatgatcactatacaatgataaaaggatcaattcaacaaaaaattacaattacatatttatatgcaccaaacactggaggaactagattcattaaacaagtactgctagacctaaaaaactgagagagttagcaaaacaatcataatgggagattttagtacaatcatgacagtactaaacagatcttcgagacaaaaagtcaacagataaacaatgcacttaaatgactcactggaacaaatggatgcagcagatatttacagaacattctatccaagatctgcagaatatacattcttctaatcagcacatgcaacattctccaaggtagagcatatactaggccacaaaacaagtctcaataaatttttaaaacaatgaaatcatatcaagtatcttctcagaccacagcagaataaaactaaaaatcatctcgctaaagaactgtcgaaaatgaacaaatacatagaaattaagaaatttgcttctgaataatatctgggttaacagttacatcaagatgaaaatttaaaaattatcttaattaaattataataatgagacaagttattgaaacctcaaaaataaaggaaaagcagtgataagaggaaagtttatagtgccagctgcctgcatcaaaaagtctgaaagagcacaaattcacaacctaatgtcacaccttgagaaattggagaaacaagaacaaactaaacatagagccagaagaagaaaagaaataacaaagatcagagcagaactaaatgcaatccaaacaaaaaaaagcaatgaaacaaacagttggttatttgaaaaaataaacaaattcatgggtcattagctagattaacaaagaaaagaatatcaaagatccaaataagctcagaaatgaaacgagacattacaatctacaccactaatataaaaaataatttgagactactaagttcaccttcatgtgcacaatgtagaagacttagaggaaatggaaaaatttctagaaacatacaacactcctagattaaataaaaaagaaacagttactttgaatagacaaataacaaacagtgagattgaatcagtaattcaagaattgccaacaataacaacaatgaaatagggccaggtgaattcacagctgaattctatcaaaaaatttaaagaagaattgctgccaattttgctgcaactattttttaaatttagataaaaaagaatcctccctaaattattctatgaagctagtataaccaagataccaaaaccaggaaaacacacacacacagacacacacacactctacagatgaatttccctgataaatatagatgcaaaaatagcaaaaaaaaaaatagctagttgagttcaacagcacatcaaaaagataattcctcatgatcaagcgtgtttcatctcagaattgcagggattatttgaacatactcaagtcaataaatgtaatacatcacataaacagaattacaaataaaaaccttacgattgtctcaatagatgcagaaaaagcattcaacaaaattcagcattttttaatgataaaaactgtaaataaatgaggcatagaagaaacctgcctcaaactaataaaagttacatatgaaaaatccacagctaatatcatgctgaatgtgaaaaagttaaaagcatttaccctgagaacacaaacaatacaaggatgcccaagttcaccaattctattcaacatagttctggaagttctagccagagcaattagtcaggagaaaaaaaataagggtatccaaatttaaaaagagaacgtcagactatcactgtttacagatcaagggattatatatattaaaaccctagactcctccaaaatactaatagttttagtaaatgaattcagttaagtctcagattacaaaatacatgtacacaaattagtagcacggctatatatcaacaacagcaatgctgagagttaaatcaagaactccatcccttttacagaagctgcgaaaagatagtatatttaccaatatacttaaccaaaagggtaaaagatctcaacaaggagaactacacaacactgctgaaagaaatcatagatgatacaaacaaatgcaaatgcatcccctgatcatggattgcaagaatcgctattgtgaaaatgaccataatgcctaaagcaatctacagaatcaatgaaattcttattaaaataccaacattattttcttcagaattcaaaaataataacgctgaaatttatttgaaaccaaaaaaaagccaaaatacccaaagaaatcctaataagataaagaaaattggagccatcacattactgaacttcatattacaccacaaggctgcagttaccaaaacaacatggcactgacataatagtaggctcatagaccactggaacaaaatagagaacccagaaataaagccacatatgtaaatccaactgatgctttgcaaaatgtaccaaattttaaattgaaaaatagacaccacatttaacaaatggtacaagaaaaactagcaagccacatgtaaaagaataaaactggatttctatctgtcaccatataaaagaccaactcaagatgaatcaggtactgaaatataagacattaaactcaaaaattctagaaaacaatattggaaaaacacttttagacatcagggtaggcaaagaatttataactaagaccccaaaagcaaatgcagcaaaaacaaaactaaatttatggaacccatttaaactaaagtgtttcttcacagcacaactaagagtcaatggagtaaaaagacaactcacagaacgggagaaaatatgtgcaaacttcacatctgacaaaaaattggtatattcagaatctacaaaatactaaaacaagtcgccaagaaaaaacaaacgatcccatttgaaagtggacaagggacataaatagatagttctcagaagaagatatacaaatggccaacaaacatatgaaaaactgtgtaacatcactaatcatcaggaaaatacaaattaaaaccacaatctaataacacctaatcctgcaagaatggccactataaaaagtcaaaaaacaaaagggaatgcttatacactgttgatgaaaatgtaatttagtataaccactatggaaaacactattgagatttcttgaaaagcagaaaggtagatctactattttttttttcttttttgagatggagtctctctcagtcacccaggctggagtgcagtggtgcaatctcatctcattgcaacctccgcctcccgtgtcaagtgatgctcccacctcagcctccggagtatctgggattacaggcacccaccatcatgcctggctaattgttttttgaatttttgtagagaaggggtttccccatgttggccaggctggtctccaactcctgacctcagctgatcctccccgctcggcagcccaaattactgaaattacaggcgtgcagcatcacacctggccagatctactgtttgatccagcaatctcattactggagagctacccaaaggaaataaagtcattatatgaaaaagacgtgtatatgtatgtttatagcagcagaattcaaaattgaaaatatgtgaaaccaatttaaatgcccattggccaatgagttcagaaagaaaatgtgacatcgcctgtaatcccagcatttcgggaggccgaagagggcggatcacgaggtcaggagatcgacaccatcctggccaacatggtgaaatcccgtctctactaaaaatacaaaaaatttgccggacctgttggcgtgcacctggagtcccagctactcgggaggctgaggcaggagaattgcttgaacccgggaggcagaggctgcagtgaaccgagattgcagcactgcactccagcctgggtgacagagcaagactctgcctcaaaaaaaaaaaaaaaaaaagaaaagaaaagaaaaagaaaatttgacatatatacatcatggaatactaccaagccgttaaagggaatggcataatgtcctttgcagcaacttggatgaagctggaggtaatgagtataagtgaagttacacaggagtagaaaagcaaaaactgtgtttgcacacttacaagtgggagatgggctatgaacttgcaaaggcatacagagtgatataagggactttggagactcagaagggaaagaataggatggatactagagagaaaataactacactttaggtagagtgtacactattcaggtgatgaatgtactaaaatctcagaatttattgctatataattcctccatctaacaaaaaaatatttacccccaaagctattgaaattaaacaaaaatcaacctacaaaaataagcatcttctgtatacactaaaaaatgattattcaaaattaaaatcaagaaaataaatctaaatacaacagcttaaaattcataaaataaattttaccaaaataaatttaacaaggatacaaaatatctgcacattgaaaattataatatattgattaaaatgtaagaaaacacaaataaatggaaggctatcttgtgttcttgtgttactggaacatacattgttaatatgtccatcctaacctaagcatttacagattcaatgcaatcccattcaaaatttcaaagatatgcatttacataaattgaaaaaaaaaacctctctcatttgaatggctggggtgattgacccggactatcaatttgaaatcagactactactccacaatggaggtgagacagagtatgtctggaatacaggagatttcttaggacatctcttagtattactttgccatgggattaagatcaatgggaaaaaacaacctaattcaggcaggaatacaaatggcccagatacttcagaaataaaagtttgggtcttcacccagattaaaaatcctgaccagccaaggtacttgctgaaggcaaaacaaatacagaatgggtagtggaagaaggtagttgtcaataccaggaatgaccacacgaccagaagtggggaccgtaattgtcgtgagtatctccttaagctgataagcaacttcagcaaagtctcaggatattttctccatatcttgttaggaatatatttctgcatgtgtataactgtactaagaaaatatcttcattgtgccggacacggtggctcacacctgtaatcccagcaatttaggaagccaaggtgggtggattacctgaggtctagaggtcgagaccagcttgaccagtatggtgaaacgccgtctctaccaaaaatacaaaaattagcctggcatggtggcaggtgcctgtaatcccaggcttctcagaaggctgagacaggagaatagcttgaaccctgaacccgcgaggcagaggtggcagtgagccaagattgcaccactgcactccagcctgggcaacagactgagactccatctaaaaaacaaacaaacaaacaaaaatatattaattgttttcattgaatttgttttctttttatcatgtgtcacaagatttattgacttcctatcagcatttaaatgttgttaactatatgtagtggtatgtatgtaggttaaggattagtgcactttcagttgtatgaaggatagctgtattatgttaggcataattatgaccttattattgtctttatttggagttcaagcatgattgcagctagatgtgtaggggtgctaagttgacaagaggtgggcttttgatgcttgatactaggtgtcaacttgattggattaaaggatgcctacgtggctgggaagtattgtttcttggtgtgtctctgggggttttgccagaggaggctgacatttgagtcaatggactggaaatttgagtttgtcatgttgcatgatccttttaaagtcttatagaacttagttgactattattttggtgtagttcatttgtataaatatttctttgaagtttaattttcttcctttgcgtttgtctgtcactggcaacacggtaattgtagccttttagaaatagcttagaaggttggcgactcatcattttttaaaaaagttagagaacagttggcatgacttttttaaattctgagagccattttttatctaacatataggctatcatgaagaatatttatagtgtgcttgagaagcatgcgtattacactgcgcttggttggaatgttctgtagatgtctattaggtcagtttgttcaatagtgttgtttaagtccatgggcttcctaagaatttttttatgggtgttctatacattattgagggtgaggtgttgaagtctcctcctttcttattgttttctatttctcacttcatatctcttaaactcttgttaatgcggttatatttctatttttataactatgtaaaatagaaataaaataataattgcttagtaattttaatgggaaaatcacataataagaaattatattttcccaaatgctgccatcaccactaaactcctccaggagtctcacatctgctctgggctctgctctctcctaaggggtcccacatcagagtttgctacagaggaggagacaagaaaatagggccctccctctcctgatgaaaaccagccctgccctgaccctgcaactctgggagaagatctctagtccagaattaccaggagtttggatttgatgatcagctctgtacaaacatggctcaccatagagttagggctgagctgggtttcccttgtcattattttaaaaggcgaataatggagaacttgagatatggagtgtgagtggatatgagtgaaaaaacagtgattctgtgtggcaggttctgactcagatgtctctgtgcttgtaggtgtctagtgtggggtgcagatggtggagtcttggggagagttggcacaagctgaatgtgcctgagactctgccgtgcatcctctgaatccaccttctgtagctactagatcagctgaatctgccaggctccaggaaaggggctgcagtgagtagtagatataatgtacgatggaagtcagacataatatgcagactctgtgaaggtcagattcaccatctccaaagacaatgccaagcacaggttgtatctgcaaatgaacagtctgagagctgagaatatggctctgtattattgagtcaaaggtaccaaatgaagggacatcagtgtgaacccagacacaaaatttcctgcagggaggagggaggaggctgggctgcagtgggcactcagcacacacaaaaggcagggacagttccaggggcaggtacaggtgcaggtgaaggcaaaggtctactttccttccagatctgtggattcctctgcatccaacagttcgcctgggcctctgtctttatggatctgcgcctaccactgatgtctctgggttagtaaagtttgctactataggaggaaacattgtcatttgtcagaaaggcgaataatggagaacaaaagatattgagtgtgagtggatatgagtgaaaaaacagtgattatgtgtggcaggttctgaccaaaatgtctctgtgtttgtaagtgtctagtgtgaggtgcaggtggtggagtgtaggggagaggcaagaggcagaaaagcgcgcaggaggccgggtgaggctgtagacattgtcagctcactatgccaatctcacaacagtgctggagaaggtgggagtctgatggagcttcccaacaaccctgtggtctaagctaagtccattaaggccgctggttcctcctggaacatagctgtccatcaggaatcccccatgtgcccagcagcagccacgcgttagcatcttcactgtgcacagtcattgtttgggaggagctccaggatgggtctctttgtcaaaaaccgggtgatggtgtcagagagctgtgccgggtgcctggtccaggggctccctgacgttggaggtataggaggtgcgttctcagggtgggaacaccttttatggaaatgtacagaagaaaacatgattttccttggtcctctcagatgacatggagaagaaagcgcgcagcttgcaaacaattgtaatgtccttgtaatttcctactttatcccaagttcattgattcttgtaaaccttggtttctgtccaagtacagagatattgattagagtgagtttggttctttccacacactaaccctcacctcccccagataaagagcacattgtccttactctgagtctgagggaggagctgttcctgtacaactaagggcctgcagagacccccatgtacagctttgcagagtcagatctttccacatgtgaggcgacctccacggcccatgattgctgctcaggtctaattgtggattcaggattaggacatcctttaggctatcacaggtcaatcagattctgaaaaatcactgttatcatagacagaggtaataattcaatacccactcccctgacagcagattctctttcttatttggttgaaagtttgaagaaaataagtgaccatttattattcttattctaactttagtatccactatttgttctaggggattcacaaatttcaaaacactgagctcttcattctcatgaaaatgtgcatatttgtgaatttcaacgtgttgttcagaacctgtgcatgccgacatctgtatttctcgtgcgttcttggcctggcgaagccctcacagaccctctccctcatctgtgctgtctctgcttctccatcacaaccagtgcttcctgctggagctggatccctcagctccccagggaagggactggagtgaatcaggtgcacaggtcatgagggagaacacaacgcaacccacgcctcaagagtccagtcaccatctccagatccacatccaaaacacagtttcttctacagctgagctacctgagcaacgagtacacaaccatgaatttttacacaaaagatacagcaaggggaagtcattgtgagcccagaaacaaacctccctgcagggaagctcaggaactgcgggaggccctcgggacaccagggggcgctcaggacacacatcaaggcaggtgcaagaggaaaaggtgctggagatggggtttggcatcatcatcatatttcactgacacccgccactgtgtttattctcatgtacgtgattctttgtattattagaaaatggcgtttatgtaaataaataaccatatgtaggtgcatcaagtcgtcctctcccttttttttttttttttttttttggagtcctgctctgtcacccaggttggagtgcagtggcgcgatctcggttcactccaacctccgcctcccgagttcaagcgattctcctgactcagcctcccgagtagctggaattacaggtgtgcaccaccgcgcccggctaagttttgtatttttagtagagaccggatttcgccatattggccaggctggcctcaaactcatgatctcagttgatccgcccgccttggcctcccacagtgctgggattacaggtgtgagccaccgcgcccggcccgtcctctccatcttatgtggaacttttccattaagactctgagtccctggatttatttgagaacctcataaatcatggtcaattatgtctctttctcctctttctcccttcttcactcctctctagctcacaaactgaaacacacacagaattttctaacttcaattacctgatgtgttgaagacaattgattaaagcgcagcttttccagttcagccactgttcatattgttgtaagaataagaacgttgtgtttctcagctgcgtgcttctctaagatgagtagcagcttttttaaataatacccagaggctgaaagcaatctgaataccaatcatcagcttaatcagtaaacacaaggtggtaaattcgctcactggaaaaacaccgattgttacaatcaggtaaggctggatactctcaacagcaagtgtaaattcacaagtatatatgctgattaaaataagacaaacaaatacaagtacatacatactgttccacttttacaaattctataaaatgaatgctaatctaaagttacataaagaaaaccagtagctgactctggacctggtgtgaggagggaagggttaggaaccagaaattgtaggaaatgaagaagaaatgctgaaggtagtggagttttttctatgttgatgaaggtaatagttatgtcactattaatcaaatcgtacacattatgggatgcctattatttgtgaatttcaccctattaaaatattacaagttaaaacaagtataattttgtagaaaattagttagacatagatgaataaaatgtatgataaataaaaaaagaaaatcacagaacaatagcataaggacttcactcatcaaactgaagaaattttaaatttctcaacacagaattaaagatttaattagatatacataagaaatcaaagactcctggatatacacacaaataaaccctaagtccacctgtatttttagggaaacgctagaatacaagaaaataatgtcatgatttcattacataacgggggttaatgaaaccacatcaggcatgtccagctgtgtcctggggttggttcagggaacgggtgtgtcctgtggttaggagacgtggcaacaagctcacagcatcagttctagctgacaccataaaaaggccaagagatcacaattaaaatgtcatgcggatgtcacatctgtgggtgcggcacactcccccatgtgaatacggaaaggttaactacactcttcaggtgtctgctgagagtagagctgtctctcaggaatgtccaaaatggctcaatagagcaagaaaggagactggctcagggttcctgtagtgccttggtggtgtgggcagagtgagggttctcactcaagaaaggagtttgtggcgtttgaacatctacatggcttcaaatagggtaactcctgtgattcctaactagattcacctcgtgtgggaaagaaaggagatgatgaaggaatgagccttaagttatcagcagtcagacatcaaaacaatagtctgatgacttattctatgtagcacctataaaaatcgttccgggcgcggtggcccaaacctgtcatcccagccttttgggaggctgaggcgggtggatcatgaggtcaggagttcaagaccagcctgaccaatatggtgaaaccccgtctctactaaaaatatttaagaaaaaaaatagttgggttatggtggtgggcgcctgtaatcccagctactcaggaggctgaggcaggagaatagcttgatcccagggggcgtaggttgtagtgagctgagatcacaccactgcactgcagcctgggtgacagagcaagactccgtctcaaaaaaaaaaaaagagtaaaaaaatatcagcccaagatgggtggacaacaaccaggcctacaaaaaaggagaagactccttataagaataagcaaatcataatgaaaattaggaggaaaacaaggagagtgaggtgaaaggcatggggcaggggattagacaagggtcctgttccaatgtcttgtgtggagacttttcactatctaaaatcatccacctattctgaatgtcttaggtgaactgtctgctccaaaacatcagaaccaccagaggatttttgaggatactcagtttaatatcttatatttgaggtgccttacaactgtgtaaaatgcttagttattatcagtgtaattagagatagggcctcactgtgtcacacaggttggggttcagtggcacaatcatagctcactgttaccttgaacttctggcccacataatccttctgtctcagcctcctgagtagcatggactagagaggtgcaccaccacacacagctgatttaaaaaaaattgtttcatagaaatggggtctctctatgttgcccaggctggtcttgaactcctggtctcacgtgattccccctggttttgtttctcaaagtggtggaattaaaggcatgagccaccgtatctgctcagaaatgattattttgttgcaaaatactaacccaagaattgactccctgaattttctctgcagcattttggttaatagtgtctgataagatttatttcaatagtttcaacagcagagtgttctcctgatgtttcctccaatagtgataatttcatggttgaagatcacaaactactattaaaagatgacataaaaaggcaaccttaaacttttggtgatggagtgagtataataaaaaattactttcaatattgtgtaacacacgcctgcagtaggaggaaggtgagcaatgagggtaaaatttctaaacgtatgaatcttccagctccccagtcatagggcagtaactgatgagtcctgagagagggaacgtaatgccgtagtgcttgtgggataactcttggccaagagagtttccatattttattaaagtggttataatttttaaatttaaagatgccattttttcaacatatccagaatattgtgagcgggattgattctgtatgatacgagcaatggcgatgccttctgtttggataatattacaaaccaggttaagactgagtggtgtaacgatgcaccagaacattattctagcttccatactagattttgtttttctctttgtttgcattagtttcaaatttatatgtaaggtctctagaatgtaggagtttatttgaaagtgtcttttcttgttggccattttgatggggcttccaggagatttaaaaacctcctctgcctgcagcacagtttaaaattctgcgttacagtagaacatctgtatttaatcctggtctttggttgattgacaagctctaatacatgcaataacttctgccttctgggctggttttacatcaggtagaggaatatatactaagtgaaaatttgcactagtaatatatattattaataaccaccacttgtattatttaagtgttattaatcaagaattaatgttaaatcaagggtctcaatggcaatattacctaagggatatacaagatattttgctaatctaggtaaaatagatgtgaacacactcttagtatccagccatgtctcctgtctatcacattattaaccacacagtaaattcacttgggacttgttctaattatctaattagtcacttacttatctcaaagcctctggattattatgtgtgactattttagcagagagtgaagaaagacaacccaggctgaccaaacaatgaggaaaatcacaacctgatgaaaccagaaacctggatgtgagtggctccaggattgaataatttgacagctcatgtgcccaggctgtttcttgtctcagttttccacactgatacatccagaaaggcagcttcaccccccagaggactcccatcatgctgtgacatggtgacaacattcccaaagctcacacacatatgttaaatattggctggaaaaggggcagagacatttctggaattctcttctgaaggaccatgaatgcctcaaccaaccatctcccctgcctccatgactagaaatgcaccacgtgcccacacggatattcatccctcatggggataagactccattgatgaggctgactattttatcatataaaattactaaagactgatttaagggtttcaaaaactaattgaactctgttgttctatgtccaccagagattacaaatcttccaatgatgccttctttgttttttgtctgcttgactttgtctcttcaacttgttctgtaccccagagaatctctttcagctccctcaggtgcattcaattgttttatttaactgacaatttctaaatcagttaaagacattacgctaaagactccatattcctaggtccatattcctttttccatattcctaggaaggcattgtgacccagagtctgggcatgaccttgtgagtgttcctgaccctcctccatatgagatgctggtctgggtgttcttgcccctttccctggggtagagtcctcctgttttccccaggtgctccctcccacagctctagtgttctcaatcagtgtcatcaccttccagatcttctgccctgccctgcagactaaggctctgattccataagcaagataggggagctgctcctcaatagatctttggtgaggatctctgttcccatctcaattcctgtagggtggaaccagtgttcctaggattctggtttcagtagcttgtccctgcagagtaaattcttagttctgtagggggattaagggagttgggtctgaatacattttagatgtcgaggatcttgttctctcccagaaagacacttcgggaaagtaagactttggtaactgtcccctttcttggggaaagggattcaagaggataggttgcttttgggcatgtggtcccttaaaatttcacactaaaaagcgtttcccacactcaatttcaagcagcccaatatatatttgtattttttcttggaacagacaatattttatattccagactctgccttaggtaatttcaaaccctggctttgttactctctacaagaaattgcttctccataagcttcagatttgttgtgtgttttgaaattttatcagaaatattaaagaaaattggcaaaattccatcctccatgtttatctgttattgttgatgcagttgtaaaaaataagaaaaatatattccttttttctgtacatttccaagcttagtagcaaatttttagtaacacccagaataataaaaaattcaaatattgtttagctgcttaataggaaaacaaattatagtaaatttgtttgctagaatgctacccagcatttataataagtaaacatttgatatacccaactacaaggtaaaatatccatttatgctaactaaaataagccaaacaaatgagaatatatactgttatttcatttttataaattctgaaaaattaaaatgaatttgcagcaatgtaaagatcagtagttgccagggaaatggtagaagaaagaaaggaaaaggagaaagaatacagaagaacaaaaggaaatgttaagaattctcttgtccaacttgataaggatgacggttacatcatttttatcaactgtaatctttaaatatgtgaaagtttattatctgtaaactaaacgttataaactttattacaagcaaaaattgaaagttagacaagaaggagtgatagaaagagaaaatgtatattaaatttcagaaatatttaagaatgtatctgcctgaaccctagttctcaccatatctttaggtgaatgctaaaatgcagcaaaatcacgcatgttctcactacagaaagtgggttctacaaaccacactcggcacatttagctttgtcctggagttggtgcagggagttattggggccagtgatgaggagcacaggccaagataccagcgattacttatcccaaacatgagctctaacatacacacttagtcccttttccgtgtgtggtttacttccacatctgtacatggagagaccactgactgacaaaatataatttatacaaatatgtaaaattaaatagggtgatcagttcaaggtgtttatcacagcataattttacaataagacagcatatttcccaaataccatcattgtcaccaaactccttcaaggcacagtcatcttatctgggccccgtcctctcctcaggtgtcccaccccagagcttggtatatagtaggagacatgcaaataaggccctccctctgctgatgaaaatgagcccagccctgaccctgcagctctgggagaggagccccagccgtgagattcccaggagtttccacttggtgatcagcactgaacacagaccaccaaccatggagtttgggcttagctgggttttccttgttgctattttaaaaggtaattcatggtgtactagagatactgagtgtgaggggacatgagtggtagaaacagtggatatgtgtggcagtttctgaccttggtgtttctgtgtttgcaggtgtccaatgtgaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagacacagtgaggggaggtcaatgtgagcccagacacaaacctccctgcaggggcgcacagagccaccagggggcgctagggaccgcctgagtacgggacaggtcccaggagcaggtgcagggggaggtttcctttttccttggctggaaaagtcacctttatcttcccagggctcgagccttctaggctgtgatattttattacttgtatttactgttcatttattatcattagtttttaaattttggtaatttttacaactctatggatatatttttaagtgtatactttcaagaaataaacattcctaattatttgcactgattctcccagagttttattaacatttgttgacatcagcaactacatagctatagggacaaacacttttaacgatagacagttgtttaggcctgaaaccccgtttatactaaaaatttacaaaaattagcctggcgtggtgaagggcgcctgtaatcccagctactcgggaggctgagcaaggagaattgcttgaatccgggaagcggaagtcacagtgagtggagtggactgccactacactccagcctggcgacagagcgagactttgtatgaaagaaagaaaagaaaaggaagaaaggaagaaaggaaggaaggaaggaaggaaggaaggaaggaaggaaggaaggaaggaaggaaaagagagaaagagagaggaaggaaggaaggaaggaaggaaggaaggaaggaaggaaggaaaagagagaaagaaagagagaggaaggaaggaaggaagaaaggaaggaaggaagaaaagaaggaaagaaagaaaaaagatatataaacacgcagacctatgcatataaccatagggatttatattaaacattacaataaaataattctaaaaatgtgtcctaaggaatcaaacataatgatgaagtaaatataaatgttagagtaatttataattgatttgttatttttaatcgtttacatgaatttatttctatttgttcatttaaaagtagtatattggtcatttcaagagagctaacagtaaatttcagatgttgttgttacgatatatgataagaatttgaggtggtgaatgataattatcttatttctcaattatcttagttattccatattgtattcacaaatcataacattgcttcttaccttataaatataaacaaccataatttgtgaaattacaataattttctttattttaattttttaatttatcccagatcattatctttttcttcgcttccagatctcactggatcatctcgagggcccatcctcacccctgtctcccgaagacttctggagaggctgcaggacgggcagaaggaggagccccgtgtgagtccacacgacctggagcctccctctccttggattaggccatctcctcgggatcacagggctcttcattatccttaccccgctgttgtaccaaacaagcaacatcacacttcaattcatcagggtttgctttaattttctaaatcatcgtgaaggtgataattttaacagtaacgtatcacaaccaaataggataagcccttttccatggaacagggtttcttatcaggatatacatgtattatggattctcaatttatttgtagatgagatgctattatctccatattgtagatgattctgctaagtcatctcttaaaattaatttttccaaagactcaaacaaataaatgatataattacaaatttcaggtgtaatagctgagccaacattgagattatattaacatttagaacatgaacttgcaaatattgttattttcctgtcggctgtccccaattgtgattttatacagaatattagaaatttatcctgataaatcaggttaaaatattatatcactagtttattaacttttataactaataatataaaatgttccacatattttttagccatgttttacttacccgtgatatgtgtatttattaatttttcattttaagatgccacctttatctttcttatttctgggattttattctagtagatagagctgaatgcattttaataattatcataataatcacatttacattttgcattttaattttcatatacattttattaatattttaatttcaatataaaatattttcctacaaatgtcaatttttgatttttatgagataaaattaacctatacaaaatacatatattttcaatgtacagtttgagggtttctggcaaatgtgcacacatttgtctccagcatctaagttatgatgaggagcaggtccatctccacaacaagtgtcctcttcggtgcttccagtcagctctcacataaggaattttttttcaaatttaatatagatacagagggtaaatgtttggatttgtcacgggggattattgagtgatgctgaggtttggaatacagattcccaccgacctctccctcccactctccagcagtccacagtgtctatcattctcataattatgtccatgtgtgctcaatgctgaggtcttacttaggagaatatgtggtattcagttttctgctcctacattaatttgtttaggattaagggccccagcttctttcattttactgcaaaggacatgatttcattctttttcatggctgtgtagtattatacattgtagatgtaccgcattttgtatattcagtctaccaatgatgtgcatctggtttgatctatgtcgttgccactgtgaatagcacagcaatgaacatagatgtggatgtgtctttttggtagaattatttgcttacttttcagtgtataccccgtggtgggattgctgtgtaaaatgatatctctgttttaagttctttgagaaatctccagtctgatttccaaagtggaaacaccaatttatattcccctcatcagtgtatgtgttctcttttctccacagtcccagcagcatccattgttttttgactttttagtgataaccattctgagtggtgcgtggctgcacacctacagtcatctcatctttgataaggctgatgaaaacaagcaatgaggaagggactccctgttcaataaatggtgctgggacaactggctaggcatatgatgaagattgaagctggatatctactttcaacatgtataaaattaacacaaaattcattaaagttttaaatgtaagacctcaaaccataaaaatccttgaagacaacctaggaaatactcttcttgacatcaggtttgacaaaaaaatgttggctgagtatccaaaaccaattgcaacaaaaagaaaaatagacaagtggggcctaattaactgaggagctcctgctcagcaaaacaaacaaagaagcaaacaaaactaacagcacagtactcagacaacctacagaatgtggaaagatattcacaaacgttccatccaacaaagccgtaatatccagaatctatagggaaattaaacaaatcaagaagcaaaaaataataataataataaccccattaaaaatgggctgatatggtttgctgtgtccccacccaaatatcaacttgaattgtatctcccagaattcccatgtgttgtgagacggacccagggggaggtaattgaaccatgggggcctgtctttcccgtgctattctcttggtagtgaataagtctcaccagatctaatgagacttatcaggggtttatctgatgggtttatcaggggtttccgcttttgcttcttcctctttttctcttgccatcaccaggtaaggagtgccttttacctgccaccgtgttttggaggccttcacagccatgtggaactgtaattccaattaaacctctttttgttcccagttttgggtgtgtctttgttagcagtttgaaaatggactaatgcgtgggcaaatgacacagacacttctcaaaggaatacatacaagtgaccagcaaatatatttttaaaatgtttaacatcactaatcatcagagaaatgtaaatagaaaaatgttctgatttctgtcactataggtccattttcttgttttgaatttcatatacatggaataaaatattatagctcatttttgtaagaagcttttactatctgtgaggttcattcatgtgatagcatctatcaaggttttgtcaacatatgtataaatatgtatgtactcatacacatatagatatttcatatctgaatcagtccattgcattaataaatgacagattattaaataaatcagttcattaagtgaataagtgacaatatgtatatctattttcctgttgatggaatttaaatttgtttccaatataaatatcataaacaaaactgtcatacatatctttgtacaagttcttctgtttatattcacatatttttattgataaaatatgttgaaatataagtatgcattataccttttcagctttatggagctatcactgacaaataaaattttctgtatttaaggtacaccaattgatgtattgatattcttggggaaatgctcataatgatcaaggtaattggcatgcctatcatctcagagagttaacattttatgcctttaatttattgtgtatgtgtgatgaaatcacctaatatctacttgtctggcaaaagatatgtttataatgcaacattcattagtatagtcacattgctgtaggtttgatctccagaactatttcaacctgtgtattagtccattctcaccctaatgtaaggaactacctgagactgggaaatttatggagaaaagtggtttagttgactcacagttctgcaggcttaacagcaagtattactaggaggtatcaggaaacttacagtcatcacagaaagtgaaggggaagcaaggaccgcttcacatgctggcaggagagagagaaagagcaaggggagatgcaccacccttttaaaccttgagatcttgtgagaactctgtcacaagaacagcaaaagggaagaccgcccgcatgatccaatcactccccatcagacacctgctacaacacttggggattaaaatttgacatgagatgtgggtgaaaacacagagccaaaccatatcattccacccatggtctatcagaaatctcatgtccttctcacattgcaaaatatcattatgccttctcaacagtcttccaggcttaactcatttcagcattatcacaaaaatctatagtctaaagtcacctctgagacaaggtaaatttcttccccctataaacctgtaaaattaaaaagaagttagttatttccaagacacaatggagatgcatgtactgggtaaatgctcccattccaaatgggtgtcattggccacagaaaaggggctacaggccccatgcaagtccaaacaccagtagggcagccattaaatgttaaagctacagcataatttccttttaccccaagtctcacatccaggacacactgatacaagggttgggctcccaaggccttaggaagctccaccctgtggctcaacgtggtacagtccccatgactgctttgataagctggcattgagtttctatggctttacaggcacaccatgcaagctgttggtggatctaccattccggggtctggaggaaggtgcccctcttctcacagatccactaggcatctagtgcctagtgcccagtgggtactctgtgtgggagatccaacaccacattttccttccacactggcctagtagaggtactccattagggctcagccctgcataagacttctgcctgaatacccagacattttcatacgtcatctgaaatctaagaggaagctcccaaacctcaactcttgccttatgtgcacccgcagactcaacaccacgtggaagcaaccaaagcttagggcttgcaccctctgaagcaatggcctgagctggaccttggcccctttagccatggctggcaggagagggacagggatgtcccaaggctgcacagagcagtcgggtcctgggcccggaccatgaaaccatttttctctactgggcttctgggcctgtgacgggagggaccgcagcaaagatctctgaaatgctctcaagatgtttttcccatcgggttcctcattacttatgcaaatttctgcagcccgcttgaatttcttcccaggaaatggattcttcttgtctaccacatggtcaggctgcaatttttttcaaccttttatgatctgcttcccttttaaacataagttcaaatttcagaccatctcttaatgaatgcatatgacttacattttcagaaacagccagggcaaacattgaatgctttgctacttagaaattttttctgctagataccttaagtcatctctccctagttcaacattgcacagatctctagggcaggggcaaaatgccactagtccttttgctaaagcatagcaagtgtgagctttactccagttcacaagaagttcttcatcttagcatctgagaccacctcagcctggactttattgtccatatcactatctgcattttgttcaaaaccattcagtaagcctctagaaagtttcaaacttttccacagcttcctgtcttcttgtgagccctccaagctttaccagcctctgtccattacccagttacaaagtcacttccacagttttaggtatcttaatagcagtgcccactcctagtgcaaattttctgtattagttgattctcacactgctgtaaagaactacctgagactgggtaatttatgaagaaaagagtttagtagactcacagttcttcaggctaaacaggaagcattactgggaggcatcaggacacacaatgatggccgaaggtgaaggggattcaaaaatcttctttgcaagatggcaggagagagacagcaagggagacgggaggtgccacacttttaaaccatcagatctcttgagaactttatcaggagaacagcaaagaggaaggccaccccattacccaatcactttatattaggcccttccttcaacatgtagggattacaatttggcatgagatttgagtgggaacacagagccaaactgtatcaacctgcataactgaaagttataacctctgaccaacatcacccaattttttcctcctcccagcccctgggaactactattctactttgcttccaagaacatgaatattttagattctacatataaatgtgttcatgcaacatttgactctctgtgtctcactccacttagcaaagtgtcctctatgtgttgtaaatgttagaatttcctcgtttttaaaggcagaataatattcacttttaggtaggaataagccacattttatctgttgattcatagatggacattgacctattttctatatctaggctattatgaataatctcacaataaacatatatttgtcacactcactttattttctctagatgtatactcagaagtgggtatattctatgttcaattcattgagtaatcttcatgctgttttttcataatggctgtactaatttgcattttgttccaaaccatacatggataactttgtaccacatattcaggtctttgtttaagtcttaaatccatttttagctgatttatatgtattgtgtgagataaggtcaattttttttcttccgcatatggatgcccagttttcacagcacttgttgaagagactgtttcttctctattgtgtgttcttggcagttcatcaaagatcagtttattgggaagaaattggtggacttccagattgtctgtaatgttctgttggattctatgtctgtttaaatgtcagcattatactgttttgatttacatagatttgattttgaaattatagaatatgatatattcagttatattttacccaaaattattttggctatttaaagcttttgtatttttacataaattggagaactttttaatatttttgtaaaaccatgccatggagattatatatttattttataggcatataatagatatacctaatttatgggaacatgtaatatattgatgcatttataaacgtgtaaagatcagatcaggattggtatatctatcacattaaacgtgtatattttctttatgctaggcacatttgaacgactctcttctggccattttaacgtatacattagattatcgttaactatagtcaccttactcatctgtcaaacatttaggttgtatttctcctatataactgtatatctgtcttcagtaatcatcttctctttatcctcttctctcttgtatccaaccaggcttctggtaaacaacaatctactctctgtcttcaggaaatccaatgttttagttgtgacataaaagtaagaagatgcaatatttgtctttctgtgtttggtttatttaacttaacattatggcttccacttccattcatattgttgcaaatgacaagatatcaacatttatggctgaataatattctattgcctacatcgattatatttttatatccatttctccacctacagacactgaggttgctttcatatctgggctattgtgaatagagctgcaagaacttggagtgcacatgcctttatgaggcagtgattttatcttctttagaacatactcagaataggatttgctgagtcatcagttatttctatttttcttttattttggagtcttcatacaactttgcacaatagtggaaatacaaacggaaaaaccattataaaaagcagtttcagttttgaggtatgatccaaaaacacacaacatttcatcatgattctcattgggagtctctaatgaatctggtggaaaggcaggaagttttctaaccttgttaagaaaattatgagtttgcacctttttctttttgaggctggaaattggcatgattcaagatgcgtaatgttagcaggtttcagaatgatacagcgaaaatcataatgagaaggcaagagagagaataagagaaagacaggaaaacaaagaaacaaataaatttcacaagagaagaaactgctggatgtcagtgttgggttttgttcctagacatatctgtactgagtgagaaaccatgaagccaagggaagagtctagaacttgttcaagtgaagcatcagcatatttctccaaggcacctattgtcaccccatcacaagggtgatgagtttttgaataccattaaatatgagttcctagtaagtaatcatgtttccatgaaattcagttaaaatgcaaagggtgtgtccagatcactcacgcacaaaaatacaaaatttgcctttgcatttatggctgcatagaggtaaagtccattgagacttcagcaggttacagagatctgttaagttttggattcccataggagagtgcctcttagtgaaggttggactattaattaagtatgtacaaattccctctatgggagtagtgttccatttgtgtggaatttttaattccttattgaattgcaaaacaaatcccaaggactgactccatggagttttactgtagtgttcataaaaatatttaataagattccttccagtgtttcaaggaaagtttttctctaaaattttttctaatacataaattttcctgcctaaaattgaaacaggctgttgttaaaaagacatactggaatggcagctttaatctattggtgataggaatgagcataatacatgaatctctttgagtgttctgcctcatccaaatactgtatggcaaaggctagtactggaggtaaaatctctaaatgtatttgttccagccatcaagtcatggggcaataacagatacatccttgaggcagaggaccataatgccacagtgctagtaggagtacatgtcgccaagggagttcaagggttccttaaaattgtgataattttaatgtaagaacaccttattagagacagggtttcagcatgttgaccaggcttggtctagaactcttgacctcttgatctgcccgccttggcctcccaaactgctgatattacaggagtgagtcactgtgtctagccagtccatttattttcttctgcacatggatacccataaacttatgtggaagattgtgggaggttataacagtgtcatactttagtatcagccatacctcacagaatcattttataatagttcctttcatgggtgtacttcactcagttcatgcaaaacctggcaggtgacaggctaaaaacacaaaataccgaagcgtttaaccaactgaaagggctgtagccttttgtcaatgaattatttcaagacacggagaacacatatagattataaataaaatactttcacatccccttaaaggtggaaattgaggaaattttacctaaatgtgtccaaagggccctgtggcttggtttctgtctaggtcccaatgatagggttctcccaggattttgtggctgtcttgttacacttcatcaagaattaacctctgctgtttcctcaaagtgtttaattggataatgaatttgtctataaattgaagagttgaaatacatcaaatattaatttgtaataatctggcacaaattatctaagcaaattcaataactagatgttttttcatttatttttatttaaaatcaggatctaagcactgatatgctttaataacatctgtgaccctctcagcagttttctcttctgagtatatgatctgctgtggcagttttcttagcttcaatgttacctcttttggcaatgactaccgtctttatatttgccaggaatctgggataaaggagtgcttctaagagttccctaacttgcccattttggtgggtgttccagaacatatgagatgctctgttgttaacaaagcatcccaaagccatgcactgccctaaaatgtgtttgtttcctagtttgacaaattggaagttctaataaatacaatcacttctgccatctgggctgattttacatcagatagagggctgtattccaaagaaaagcttacattagtaatagcaattctagtcagaaacctagagttttatcattgaggtgcaattcataacaaataatattaggtcgaggttctcagtggcagtgtctaaatctcttaggtgtacagggtcttccctgttaacatgaagcatttataagcacagtcatagtttccagctatgcttctccctgtctcattatcaccacaaactatggcctcacctggaacttgggttaatttccaaataagtaattttttagtgtttatgcctctagattattatgtgagaaagttaacattcagtagaaagttaaaaagaacatttgaactgactaaacaacacagacaatcaagaataaaattcaaagcctagatgtgagaggctccaggcctggataatgcaatagttcatgtatgcaggcagtttctttgcccagttctacactgatacacccagaatgtcagcttcatgccagatttgactcctattatgtagagacatggcaatacattctcaagggtcacatgaaataatatgaaaattggtgggaataggggaggagacaactctgcaattctcatctgaaggaccaggaaagcctggacagaccatctccccagcctccgtgactgcaccacgtgcccacatggacactcatccctgatagggtaagaagactccattgatggggctgagcattttatgatagaaattactagagactgacgtggaggtttcaacaactaatatttataaccaaaatttaattacccccacattgttaccattttcttcagtgaaaaattgcttgccatgattaagttttaagtagatttccaatgttcacaactgagcttccaagagagtcttgagaacaaaaacaatgagggcagagaaatctaccttttctgtattcaccactaaactcaagtggactcagcactgcctttgatcactgctacttctctgcagagttcaggtttctacttctcacaattctgacacacattctacctctcctcaaatgtttggcctctgcttcttgtaaggtcaccctctgttcttaacttcttctctgagtcattttgtgaggtggtcatgagccattaaatggatattttatattttcccaacatgaatcacatgagtggtcatgaattatacttctgattatggcagttgatttttcttggcatgttcatgactagtaatatttgaagccatttcattcaaatcttcggggcttcgtttttgttgctatgacattttttcttctattgagtctttccactagtattataacatgacctagtatccaggctcagttgtcattaataataaccacatatgtcaaaaatcatgcattcttttcacagcagacataatttcctcttttctgcagatgaagacacactgctgagctacccccacttacaagaatatatgcacaattatgatatcttcatttatttgactaataagctatatcattctcccttcaaattctttaccccccagaagtcctggacaaatttctgcatctgctcaaacgataaactcagaactacatggtgagtaaaagtcacctggttctggatattgggtccatctcttcccctccaatgtcccagagcacctcagcacacctgtccaggttctatcaagaaagagtagctcctgcacactgaaggaaacaattgagttaagagaggacctgcagatgatagacaatattgaaaactattaatatgacaaaggattactaccaagcatgtgaaataagctcaacgggtgcggtggttcatgtctgtagtaccagcaatttgggaggcaagttgcgcagatcacctgaggttaggagctcgacaccagcctgaccaacataaagaacaccctgtctctactaaaagtacaaaattagccgggcatggtggcatgcgcctgtaatcccagctactcgggaggctgaggcaggagcatcacttgaacctgggaagtggaggttgcggtgagctgagatggcaccattgcactccagcctgggcaacaagagggaaactccatctcaaaaaaaaaattacaaaaaattagctgagcgtggtggtgggcgcctgtatacccagctgctagggagactgaggcaggagaatggcttgaacccaggaggtgaaggttgcagtgagctgagattgcgccattgcactccatcctgggcaacaagagtgaaactccatctcaaaaaaaaaaaaagagacttgcaaagggcaaatagatcatagacagacagatagatagatagacctattagtatacatacatacatatatatacactaatattcaggaaaatgcaaattcataatgagatgtcttttcacccttcatctctgctagaaagtttgttatctgaaaaacaaatacatacatacatacttattaaaagctggccaggatgcctagaaagtaaaactcatagaccactggtggaaatgtaaattagtgcagccatcaagggaaaaaaatagaactaccatatattccagcaatccaactgctaagtatatatctatttaaatatttaaaagaaaaaactaatattgaagagatacctgtacacccatgtttattgcagcactaatcacaatttctaagatatgaaatcaacatatgtgtccatcaacagatgaatggatacataaaatgtgatatatttacacaatggaatattattcagccttaacaatgaaattctgccgtttgaagcaacatggatggaatgggacaccactatgttgagtgaaatgagtcagacacagaaaaataaataccgcatttctcagcgttacttctagaagtaaatagtagagtagtggtgatgagatgccaggaatgagagaaggctgagataagaagaggtttgttaacaaacacacaattacaggtagacaggagggatgtgctctagtgttctacagcacagtagggtgactacagttaacaatatattgtacgttttctgtttacaagaagccagaagagagaattttctatgctaccaacacaaataaatgttagtgtctgaactgacgaatttgctcattgttctgattttggtcataccaagtggcacacatgtattcaaatatcacactgtatcccataaacataagcagttattatgtgccaaatttgaaaaatcctttaattaaaaagaattatattggcgtacattacaaatgattcaacacagagacaggaataaataccatttttctttgaaatagttaattaactaacaatgtagttacattcatttgcaccaaatcgtgtatttgataatggtatgcatagacagatttatgcataggataatatcttttaattttagactactacttaatactataaatataaataattttaaaacaactaagtaaaaagaataaagctgagaaaatgtgtgtgtggtgtgtgatgtgtgagctttttcttgtgcaccactgtgtccttggtggatgtgtggttcatgtgtttgtttttatttactctgtttggggttctctttgcttctaggatctgtagttcagtttctttcacaaaattgggaacattcttcgctattatctttttcaaatagtttctgtgtatttataatttctccttctcagatttaaaatatacacatactataattttgatattaatgtttagtttctttcttcactctcttttcgtttgcaatttactttgtgaaatttctagtgacatactaatcacatggttttattgaaaagctgagccagctctactgaggtgtgtgccaaaagattgctcgatgtttatacagcattgcttttgatttcttatgcatttccatttgatttattcttagtattttcatatttcagttccctatctatgtccacgatttctttaagagattcttgcgtgtgaattatagttactttacatatcttgtttaattagatatttataatatctgtttcatctacaaatctcatgctgatcatttgtttattacaactttggtacttctcattaatgtatgtaataattgttgatagccacagatactgggatggacagtggatactggccttattatttcattttatgcatttctgcctgtatttgaccacactttacctttgccaggcctttactgtggaagtatctgtgaatcttctcagaactatatttgacattcacttttgcagtggacatcaaagttgaagtctgttcttctgtgtccaccagagacttcagttcctccagtgataccttgtttttctttcctgcttggctttgtctcttcacctgttccctcctccagagaatcatgttcagctccctcaggtggattaaaatgttatttaactgacaattgtgaaattggtggaaagcaatagaataaagggagattttctgacctttcttgggttcatattgtgaacatgagtctgggtgtgaccttcccaatgtttctgaacttcctccagatgagatgttggtctgtgtgttcttgctcttttccctgctgtggagtcctcttgttttccccagttgttccctcccgcagctccaatgttctctttttgtgttatcaccttacagatttgctgactagaactgcagattaaggctctgattaaataagaaggaggggagatacttctcaatggaacttaggtgaagacctcttttcccatctcagttcctaagggattgcccagtgccctaagatactggtttggtggcttgcccctccagaataattctttgttctccagtggggatatggaaggtgggtctgaacacttttcagaagggtgggcactttttctctcctagacagacacaatgggacagaacaattttggtgactgtccccattttggggaaaaaggattcaataggataggaaaactcttcagtctgtggtcccttagaaattcaccctacaacacatttaccacacttgacttcaagaaatccaatatatatgtgtgttttcatcttgtaatagcctacattttacatgccatactctgcctcagttcagctcataccccagctttgttactctttacaagaacttgcctctccctagatttcacatttgctgtttatcttaaaacttcaagtatctaaagtattatttttaaaaaatggccagttgtggtggctcacacctgtaatcccaacgctttgggaggctgaggtatgtggatcacctgaggtcaggagtttgagaccaccctggccaacatggtaaaacctgtctctactaaaaatacaaaaaaaaaaaaatagcttggcatggtggcaggcacctgtaatcccagctactcgggaggctgatactggagaatagcttgaacccacgaggcagagtttgcaagtcgtaccattgcactccagcctgggcgacagagtgagactctgtctcaaaaaaaaaaattccaaaattccagctcctctgtttatctatttttgttgatactgttgttgtaaaacataagtaaaatatattattcatctatgtacatttccaagctgtgtagaagaatttttaataagacccagagtaaaaaaagaatgcaaatatgtaggggccagccctacagggtctgtggatctttctccccatgtgcagagatgagagatcatagaaataaaggcacaagacaaagagatagaagaaaaaacagccgggcccaggggaccactaccaccaagacacagactagaagtggccccaaatgcctggctctgctgttatttattggatacaaggcaaaaggggaagggtaaggagtgtgagtcatctgcaatgattgataaggtcatgtgggtcacgtgtccaccagacagagggcacttccctgtttggcagccgaggcggagagagagagaggacagcttaggtcattatttcttccattctcttctcagaaagatcaaagactttaatactttcactaattctgctactgctatctagagggcggagcaggtgtacagagtggaacatgaaagtgaaacaggagtgtgaccgctgaagcacagcatcacagagagacgtttaggcctctggagggctgcgggcaggtttgactgatgtcaggccttccacaagaggtggtggagcagagtcttctctaactcccccggggaaagggagactccctttccaggtcttctaagtaatgggtgccttcccaggcactggcgctaccactagactgaggagccctctagtggccctgtccgggcgtgacagaggctcacactcctgtcttctggtcacttctcaccgtgtcccttcagctcctattgctgtatggcctggtttttcctaggttataattgtagagcaaggattattataatgttggaataaagagtaatgctacagactgatgattaatgatattcatatataaacatatctataacctattactagtacaactattcttattttacatattctcttcattacactagaacagcttgtgccctcagtctcttgcctcagcacctgggtggcttgccgcccagacaaatattgttaagcttcttaatagaaaaacaaattatggtaaatgtgttcactggaatactacccgtcatttataataaattaatgcctgatacacagagcaacaaggtaaaatatctaagtatttatgttgagtaaaataagctaaacaaataagaatatatactatgtaatttcatttttataaattctgataaataaaaatgcatctgaagtaaaataatgaagataagtagttgcctggggaaatggtagaagaagggagggggagaggaggaggaatacagcagaacaaggggcaaatgttgagaagaattcacttgtccactttcttgataatgatagcagttacatcatttttattagttgtacattttaaatatgtgaagtttatcatctttcaattaagcctcataaaatgtcttacaagcaaacaaatggaaacttagacaaggaaagagtaatagaaagatagaaaaaataagttcaatgtcagaagtacctgaaaattaatgtgcctggatcctagttctctccatattttcagaagagtgctggagggcagcaaaaccacacatgctcttattacggaaagtgggttctgataaaaacactagacacatccagctttgtcctggagttggtttagggggatgtcagagacagtgatgaagagcacagggccagataccggggttcactcatcccagacatgagctcctagatgcatacagagcccccccatgtgtgggtttacttccacttctgtaaatggagaaaatattgtctcctacagaacatagtttacatgaatatttaaaatgaaatagggtgattagtgcaaagtgtttatcacagcacaatttcataataagacagcatattttccaaatgcaatcattgccagcaaacttctacagggcaccgtcgtcttatctgggtacagcctactcctcaagggtcccaccctagagcttgctatatagtaggagatatgcaaatagggccctccctctactgatgaaaaccaacccaaccctgaccctgcagctctcagagaggtgccttagccctggattccaaggcatttccacttggtgatcagcactgaacacagaggactcaccatggagttggggctgtgctgggttttccttgttgctattttagaaggtgattcatggaaaactagagagatttagtgtgtgtggatatgagtgagagaaacagtggatatgtgtggcagtttctgaccttggtgtctctttgtttgcaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagacacagtgaggggaggtcagtgtgagcccagacacaaacctccctgcaggggtccgcaggaccaccagggggcgacaggacactgagcacagggctgtctccagggcaggtgcaggtgctgctgagggctggcttcctgtcatggcctggggcggcctcattgtcaaatttccccagggaacttctccagatttacaatcctgtactaatatttgatgtctctaaatgcaaccttttttttcctttttgtgtctgtttttttttttttaaaaacaggaggacacatcctcacctccacagaagccacagtgtcactttgggggcagaaataatcctttcgtggtcaacagggtgagagttttgaggaatcccagggaaacctggggaatgttttccaattagactcagggcagagacctccatgggaatctctgattagaacaggctttgagttctgatgggagccaaaagagaggctcacccagggtcagggttcttaaaacctgatggttttcacagcaatcccccttcatcttgtgaaactgggcacatctgactcagactgattcagttgaccctctttctgctaatccattttccttcccagtagacttgattctcacagatccctttcttcttctctttcctgaaaacagaggatgtgttttctgtagtctaaattccaaggctcaggtctgcaggagctgggtaggctgaggggtcttcctcactcactattgcctggaaaatcctgctgtcttctgtgcatggaggcatttggaaaatgaagcaggcattagtcatgaagggaataatactagttttctccaatgggatgttgatgtagagctgatcttatgcttctcacactgtcacaaagtttggactctcacctgtgactttgaggagagcttgtgataccttatcttgttttaatatgaatagactctcccttagctcaggaagctggaacagactccatttggctccttcatttgtaagacatcaagggctcctcacccacccccttcctcaaggacttaacttgtttaagctgactcccagcatctcaaagagtgcgattaactgataaggtactgtggcaagctgtgtccgtagttcccaggaatttggccaggtgatggtaccctaaagcccctgcatttctgtctggcagataacacccagagcccccacacctatcatcttgtgatgaatttaaagcccctgcacctggaactgtttgcctgtaaccatttgtcctttcaacttttttgcctgttttacttctgttagaatgctacagttaggctccccctcccctctctaaaccaaagtataaaagaaaatctagcaccttcttcggggctgagagaatttccagcgttagccatctctcagttgccagctaataaaggactcctgaattcatctcaaagtgcggcgtttctctctaactcgctcggttacaacaagctgaggatggacactccattgtgcagtgagctctgggtgacagtaatcgtagggtctccccgggcagcctaaggtcaatactgctggccgtcgggaaagacaggctggaattcctgggaagacctgcatctgccatctaccacggagtcctatggtcttctgttacactctctttgaatcagcaccacctagattatctaaaacactctttgtgacttcatgactgggaaaaaataatggcagtctctactaacacctgtgttaagccatgggagcaacacctaggctagtgtgtgattgagtagttgagactgtggtctagtcaaggtgacacataaaattgattgttgccattatgatattttattttatatttgacaatataatcatgctcatattataaatatttctgttacattatttgtgtcagaggctttggaaccagaacaacttcatcttgaataaggggtaggaaaaataagactgagacctgctgggctacattcccagtaagctaaggcgttcttagtcacaggatgagataggaggtctgcacaagatccaggtcataaagaccttgctaataaagtttacagtaaagaaactggctgaagcccaccaaaaccaagatggtgacaaaagtgacctctgtttgtcctcattgctcattatatgctaagtattatgctttaacattctaaaagacactccccacagagccatgacagtttacaaatgccatagcaacatcaggaagtttccctagaaactaaagagtggaggaaacctcagctttgggaattgcccggggaattcatgaataatccttcttttgtttaacgtataatcaagaaataaccataaaaatggacaaccagcagcccataccacttctctgcctatatagtagccattctttattctcttactttcctaataaacttgctttccttttattctgtagatttgccccaattgggatccctttccagtaacatttgtgttattattggttttctaagcagaaaactctgagaggaggtgtcagccgggcttcctgggttgagtagaggctcagaaagcagtgaaactcactcatttcctgcatcaggacttactttggtcctggatgaataatattgaagatatatgcttaaaatattcctaacatcacaatttgtgcatgtgttttcttccctaagaaagctataaacagtgaaaattttgctgtaagcttccctgtgtcttctctccctctctccattccccctcccctgaaactaaaaggaatgttttaacattatgggcttttaagtctgtatttctgtgaccagcagaccttatctatgctcccaattcaaattccttgtaaacacaatttgtaaaatcctgcgagatcctgtctccttggccacgccactgcaaggtcataaagtagatcaaacttaagttacaattctgattttcctcaagatctgagacatgttaattgtctttgtttcttgctcaggtaacatctctttttgctcttttttatctctttttgcacttaaatctaagtttacattagtcatgtatctagaatgtagaaatatgtcttaaagttacttaactttttaaaaaatttatggggtttccagaagatgtgagaacctcctttatttataaaatagctgattgcacgttgctcaataatttcctctttaatttatctctctcctgtcacattatactatgataagcaaaaagaaatgaaggcataccatcaacagtttacttagatatctcctcagctaaatttctaaggtataatttactaattctaattttatccaatttaacataattaagataaattatataacaaggtacacatatgttccagttctaacaccatgtttgtgacagaaataaaacagagcttctctctgtaatgtggtcatctgagccctgaggtgatgggtcacataggtatttttatgatatttaagggtttggtcaagaacagtgataacaagtctgaacaagactggtcatacttgaaaggttacaggtaaagttactgctgttattttatattaacgccttattagaataaagctcagaggaagaggccacatcctaggtcacagtaggaggaggaatggagctgtgctctgctctccacactacttttcacatcccaggcacaagcccaggttccatgacgcacggcatctagagggcagttctcaggggatgatctcagggcacctgcttcctcgggcagggcgcttccttctctcaattgcagacttgctccttctgcaaggtctgaagtcagcacttgtattcccatgatttttacaggttctcttccctaatatggcaaaaatctttttattaaattttcaattttattttctctgaagcacactgcattagcagaaacgaatatatcacattccttatccgcccacacagccaaagattcctgaagacagagctgatgtgacgtactcataggtggatctctgcccctcagaggtggccttggtcttcaagtttcagcaatttctaggaagccaaagacacctccatctactcctccctgctcgacagctcacctgagaacagctttctcattggaatgtcttgtgtttaagaaataaaagttgctgtttgaggttagggagcccaggtgcacctaccagatccagcccaggattggagatacttttcagaagacaacatcacctgagacacgaccagtcccactgtttcactttcacaatttcagcttcttcagaagaaaattaaaattgttgagacttgttcataagcgttgtgccatgtcctttctctgttttcttgcctgttcattgatgtcatgccaggtgccacttctatgtaataggatcagaattctgcctctagtaacacatcagaggtgaggtttgattgtacttttggtttatgctccaaaacgtagattataaaattcatcaccctcatttttatgtcaaaagtaatctgcataatctggatgtcaatactttttggaatctatgaaataacagaaattgcaagaaatattacccactccaaacctggagagacaggcatgtgcagaatggcaattgacacctgcttaactggagcagaagctgcagaagccacaagctgttgagggcacttacatggtaagcactacagacgtctgaagacagatgtggactcagtaaatgtaacagttccagagggtcttatacttctaagttttctggaatttctttccagaaacctcaagattctaaaatgtacattccaaagacatttcctatagatcaaaattgcagatattaattactgagaaacataccacgagccttcttcaaaagcttctacaggaaaggacttttccagaaccttatcctatgtgaaggaagacaaatctcccactgcagatttctctcccattcttccataattgtagaaatgagtaaagttagccaatagaggtaagatataagtaaataatccagggatgctgaaaacaaaaaagggagtaatcgcccaaaatgagcttttcccctggagacgcctggtcaagatcataggccagaagaggaagctgactgtgtctctaggtttccactgtcagaacaggcagtgcttacctgcactgcacaatccattctaaccaggatgatggctctggattaaaggtgaaagtgtggcaatgcacagactctatctgaggagaacacaggaaaactaaaggacaacggcagagggtgagacaagaacagtagagcaatctgaagcctctgacatcatgatttttaagaccaatgtcttaaacactccttcattgacctcagcttctttcatcatgaagcctttgcagtgactctatctgagaaaaagaaaataacctcctgcatgcacttctcaagtctctgcttgtatcctgtttgctttaggtctctaggggaaaaagtcagatacctggacctagtgtcagtgtaggaggcacatcctaaaagctacaaactaggaagaagggaagatgggtgttattggaatagtggatatggagtgggctttcttctgaaagtatatgcacctgctggtattctcagatgcaacattcaactgcaagagcccattgaagaaacaaggcactcccaaatctcctgtaagattctgtattcatttcagataagcccacatgtccccgcattaactttttcttcagacaagcacatacatctgaaactgaacagctatgtggcaaaataagctcaggatagaagtaattgtggactccagctctgacaatttgtagatctgcatttttaaaattctaactgaagactttgctttattgtagaggacagtggtttacagctcgaattgcacagcctacaggcagatgtccatttcctctgggcaaggtttatttttatttgtttactgtacttatttgttgacaaacattgatactataaagataccctaacagcgtccacatgaaagaaaaagaaagagcaatggacacatcaaccctgaacatccagtcccaggaatcctttgaccctgccctccttgcaacccagagatatagattggatgagccctgctgagcagaacacacatgtccccaggagaaagacatggaaatgaggcccctccctgctaatgaaaagcagctcttcccctcttctcctgcaggtcctggtgaggagccacccaatatctgtgcccttcctcagtgtccacaccatcgggtctatgatgatctgggcttcacttgtcatcactctcaatattgaggttccccgttaaacagactgagtgaactgtggctgctccacgtgggggctgttctcagtctgttgcttctgtgcttgcagaggtcccctgtgaagttaattactggagtctctcagagaaatactacagaccaagaattctcagacttttctggaaaccctgtggattcactttcactgaaaacagcataagcttggtccagcaggcttcatgacaggggtgggtgtaggtgataacatcagtaattcaagtggaagttctcagtgggactctccttgagtacaaagaagattaacagtcctcagagacacgcttttcagatgattctctcttaagatgattaacctgagagctcaggaaaattccgtttattactgtgagggacacggtgaggggacatctgtgtgagctcagacacaaacctgcctgcagggagacacaaacctccctgcatggtagatgcttctcagaaccaccagggggtgcacaggaaaccagaaggtgctcaggacaccagggggtgctcagaaccaccatgactcactcaagacgccaggggcgctcagaaccaccgtggggcactcaggacaccaggggacattcagagccaccaggggtggctcaggaaacctaggggggtgctcaggacaccagggggactcaggaaactagggggtactcagaaccaccaggtggtgctcaggacaccagggagctctcagaaccatctgggggcactgaggaaaccaggggactcaaacactagggtgtgctctgaagcaccagcggaccctcaggactgcagggggcgctcaggacactagggaacactcagaaccaccaggaagcgctcagaaccaccagggggccctcaggacatcagagcgtgctgaggacctccgggggcgctcaggaccttcagagagtgatcagaacaccagagggcgctcagaacaccaggaggtgctcaggacagcaaggggctctcaggacactagggtgtgctcagtaaaccaggggtccctcacaaccaccagggggcactcaggacaccaggggatgctcaggacaccaggggccactgaggacaccaccgctcccttagcaggcagctccacatcaggcccctgggttggggcaggaagggtgttttccttttggatcttgccactaaactcttgggagtttttctccttcctttgtggtttcaagaaacattggtagattcttctcaggtataaagctctgctttcttgtattatgtaatgtttttggtttcggatgttaccagaattacactgcactgtgagaggattcattcctcgtgtgtgcaatagtgaatgaaagctgcaatgttaggggtggctttgaaagctacgttaggggtggctaagggcagttagcaggaaatgatcatcactatagaaggctactcatttctttgcacatttccataaataattgtagtttatgccctaaaaactgcatgctttcttggccctttttcttaaatgcctccaatccaagaccagtcatctaattaagctgtatgtcaaagaccaccaatcaagttaagtctgtttaatgaaacactttgtaaacaaaaaagtacatctgtgtttgtatagtcagctttaaattttacattgctttacaaatattaattttgtaaatttagtctcataattatcgtcagtatttaaaatcttaaagtcatgctatgttaaattaagtaatcttagctttctcactatgaattagagttactaagaattagaatagtaagagcatgtaataagcttttggtgaagtttataaagaaagatgaagatacgttttttgctttaaaatattttgttttccagtttacaggacctttctactggttttaagataacaatcactgtttacatctaaccctttttttaaacacctgctgtttaagattataaaattataaaattaaaaacctagttaaaaccagattgatctttgtaatttaacaagatgttcagtattgttgttttaataaaaaaaaataggtaaatacttagctactagaaaaataatcatctacttaatcataaggttttacttaggtaaacacctaaatttcatgggttataaacatggttaataggtgaaaaactttaatggacaagtattacagttttcataaatattctaggtaagctatttaaaaaataaattaggtaaatgaaataaaataaaccatttaaataaacttgttctacaatttaaaaatctaaagtttaattaaataatatatattatataaatgtttatgcattactaattgtttaaaatatatatactataaggaaaactttttaaaaatacatattataagaaaatattttttgaaaacatttgtttttagaaaaataatttatttaattcaaaggttaattataaaatgtcgtaaacatacccagttagtaagagaggtttaaagaaagttctagacatagagaagtacttttggtaagaaaggttaaaataaaaaaaaattatatgagaaggaattttgtaggataactttttatatataaaagtgactatttatgaaagaataatgtttagaataaaacaagatgttcaagtatgccataaatggttcgtgtaagtcaaaataaggtttatagaaagctaacttattaaaaaaacttcatgttatcgagttgactataattgaaagggaagaatttattatagtctttatagggatctggctttcatatgaaaatatactaacacactgaagattggttagaatgacaaaattgtcttaaagtattgatttattcaataaaattataaggtattataattttttaacccaaaattttaacttttgttgcatcttgccatttttatttttttccatttgagaaggcttgagaggatctcaactttttcatcagctcctttaacattgtttcttacttacagcagttagcctctgagttaacttctaactgttgttagtttctgactgctattatttcctgatgttaaaatcctctatcttaaagttctaaataaaatgttttctttcaatataatattcagtgtccttggcttttctttaactgtctaaatttttctatgaaaccaaaatcttcacttgtaaagacacattcttcctaggtctgattaattcaaatacttttttcattagagttgacttgcaggttatgtacatggagttccccatagggaaaaacagtcacagtgcagaaggctttatttttgctatttggtaactgggcatgagacaaattttaaatttcattgaaataattcctatgtaagtgttattaagtttttcaactacttagtaatactgagagtttaagacaatagaaattaatgttatgacattcatgtaactatctgtataacttttaaagtccttgtgctgctactttactgagctttgaatcctaggtctaaaaaggacacacaacactttgggaggctaaggtgggcaaatcacctgaggtcagaagttagagaccagcctggccaccatgacaaaaccccgtctttactaaaaaatacaaaaattagctgggcatggtggcaggtgcctgtaatcccagctacttgggagcctgaggcagagagaattgcttgaactcagggaggtggacgttgcagtgagcagatattgcactactgcactccagcctgggtgacagagtgagactccatctcagaaaaaataaataaataaaataaaaaataaaaaggacaccaagtccagctaaatcttaaacaccgacagcaattaaagccccatctacagacctggaagaaaatgacaagaaaaattgatcacactctcaagacacaagcccagaaattgaaactacttaaccaccccagccccagggactattacagaagaagtggctttgtaagattgtaaaagctaattttgagagatgaaatcagttcagagtttctttataaattaaacattaatgcaaggctagcatctgggcccctgtgccagattgaccagggtttcttgaagaattaatccacatttaaatttaaaaaacagataaaactgtataaaagatctatgcaaattatttttatggtaaaagtaattataatttaatagatttatttttcagaattgatagttttaacttttctcatgctgttcttctaaggggttatattttagaaaatcaattctactctttcaaaaatattttttttcttttttttagaaatcactgagttttcatgtggctaaataaataacttattttacaataatctgtaatcctattttgtaatatcaagtgttgtaaacttttgatatttgacaaagttcacaaaataaaattctaaattcagtcatttgaacaccctgaaaagaaacacatttagcttatttggtacagttaaattatacaggaagtaatgtcaaatttgcaatggttattaactttggactatatttatataaatgtggactatataatttgaatatacttatgtaaagagtatatgttccaaaattctattagattcaagtgatttttatatgtcttagtatcagtagtacttatgattataatttaaaatttttgtttatcacagaaataaccaaattttctcctcaattctgtctttaaccaggggtattctaaaaggtcggtcattcacaattgttgttttactttgattctttatcaggtggcttataataatctatagaactttgagtagtactcttaaatatacaatatacaattttgacaattttataaattgtgccattggtatagagagaaaaacttccatgagtctcatgagacctgaagcatttatgatgattgttaatctaatatcaagcaggacaggatgtaattgcatgaactgaatgaaaaggagactgaaataatttttataacttattctttaaagcatttgctatttacttatgttttattgttcagaatcaagaaaactttgtcttttaagctattcacagtttttaacaattttaactatactctattgagaaaaattgaaaatataatttcttcttctctacataatttctccaaaatttggaaactgtaggtattcttatatcaaaatagttatttgcataggttcgataaaaatctgctttcttccataacagagcacaattagagacaatggtcactttaccaaggctttaacttgaatgacatattttctgatttactttataaaatgaagagctgtacagctgatataagcccctttggaaaactggcattttacctttttttttttttttaacagggccctgagctgtagtaagtaaataattttgctttctgacaggcccaggaaacccaagttttcttggatacttgaaaaaataaaaagtaaaccaatccatatagctatctgatggcacagataaaatattggctgggcttgaggcttttaaagatcttacccttagattccttataaaaaatagcaaaagcaatgtatgaataaaacagcctatgtacaacaaacaacaacaaaaacaaaaacaataaaaagagagctaatatgttaagtgattatttttgctgcatcttatacaaaaaaatcaggccaagtataataagcctaaaatttattttacaaataaattagtcctattatgattttgtctccaataaaattggggaattatagggagaaatattctttcaaaataaactatagtgcatctgttattaggttctaaccttgtccacttgtttttcaatttacaatattttccacaatttggactcaattttaaaatatttctttccacaagtctccaaaataacattttcagtgattttctttttaaatatttttttcctatttgaaatctccagaaggtaaactgtgctttcttacagctagtcaacttaaactctaaaataaaataaaatcaatgatatggtttgtctctgtgttcccaccaaaatctcagtttgtatagtaataatttccacatgtcaagggtggaaggaggtgaagataattgaatcacgggacgtgttttctccatgcttttatcctattagtgagtgagttctcacaagacctgatggttatataaagggcctccctcttcacatgacacttctctctcctgcagccatgtgaagaggtacgtgtttgctgccctttccatcatgactgtaagtttcttggggcctccccagccatgtagatctgtgagacaattaaacctttttttaaataaattatccagcatcaggtatgtccttatagcagcatgaaaattgtctaataccagcaacttaattatatacaaaaattccttttataccctcctactgtgaagggaaaataaatcttgagaccccaaaattactaagctaaagagaagagtcaatgtggtgttacaggagatagaaagaaattatttaggtagatagttgggatgagagagtctctggcaaaataacttttcttctaacaaaaatcagctcagaaataacttcttctctaattacacacagttcaaagaaatcacttctaacaaaaagcagactaaataatcaggctgtgaaatatagataagcaactctgccacagagagggtgtttctgggtgtaatcaccaaacctcacatatataggatgggtcccagtaaaaacagtgagccttaataagcacattccttttcttttctgggagtacactaagatagaaaagctggaagcttgcacggggtttgcgacgccggcacctgtgaggaagtacctgggaccaggcaagaaaacccttctggcctttcttagcacatgcacggtggaagaagataagcagtgtggaggagatcaagcaaagtgcccgcctgcccaatgaaagcatgaggtggggttgccagagactttgctctatgcagatggcacacattgtcctaactgtttttgcaccctatgctgataagacaccgtctccccacgagcacatttataaaaatccttacattttactgcagcacgataacccatttgggacccctctctgtgacagacagctttttttttattttacctattaaacttgtgctctaacctcacccttagcatgtctgcgaccttgatattcacggccgtgagacaaagaagttcgggtggtattccagacaacgaggctgccatactggaaagtgctttgggcaaatctgcctccccttctgtttaaagtgattcctctgaggctaacctgagaccaatacacagctgattgcttcctcttcactatcatttatgtaaaaacgaagatccactgagtcagactaaattgtgcattcagtggtaggctaataaagtactcaaaagaacgcaacctattgtctcttatctacttctaaactgcagtccgtgcttttgattcgtcctgccttacaggaaaaatccaaagtacattttacatatattgattgatgtctcatgtctctctaaaatgtataaaagcaagctgtacttcaatcgccttgggcacatgtctcaggacttcctgaggatggtcatgggtgagttcctaactttggcaagataaacgtattagtctgttctcctgctgctaataaaacataacaaagaccgggtaattgataaaggaaagaggtttaattgactcacagtttcacatggctggggacacttcacaatcttgtcagaaaagcaagcgacatcttacacggtggcagactagagagagcttgctcagggcaactcctctttacagaaccatcagatctaatgagaagtatttactatcatgagaacagcatgggaaagacctgcccctgtgattcaattatctctcattgggtccttcccatgacacatgggaactgcaggactagaattcaaggttagatttggatggcgacacagacaaaccacattagtaaacttcctaaattgactgagacctgtctcagatatttgtcgtttacctaattcatgttcagccttcagagttccaaggcctatatcagttttccaggattgtttcccctttttgttgtttgttatttcctcctttatttatatgttttacttctcttttttctcccactattttcttattaatggatgtgaaacttcacaacatttgaaatataggtaacaatgaactataataacaacttgggacctatttatctagaaataatccgtcctacccatgaaagaaaaaaacaaaaacaaaaacagaagcccagaaacttattttgtggtaaaatgcttcctctgaaatattttggaaaggaaaaagttgggaagatatgaaatgaaaataaaaacttctgatgtcaattcattatgtcatgagggggaaaaaaactaaacgatgatccacgcaagaaactgattttcctttcattcctgagaaaatagccacagacagataaaatgttagatatcttcacagatagctacaatttgttcatctttgaaatacttagtgcaggagaaccacttgatattctatttccctatgtgcttctttttcattactacatgtaagttttcatgcaattcctccttcccctctagccagcttttcccctttatatattgaaagccctaaaaaatgtcttttgggaatggcactaaccacgcattgtttctgtgattacttttcttccaagcatgccataactttgaaaaattaattttaatttgattgagagctctctcagaaacctttggttacactaggcaaaatccaaaatcaggagccaattattgtaaaaatcagccatagtacactgtgcgtctgtgtgtgtgtgtgtgtgtgtgtgtgtgtgtgtgtgtgtacatgtgtgttttaatttttgtgagctttgagccatgtagttctctctgtggagatactatttggcgtgactttgaatagagaattctaaaagaaataagaagctcctatgagttctctgaaagtttctggactcaccatggatcttgactgtgtcattgcatcagacagtcccagggaacagactctctggtggtttcatagaatctatgcttgggctctccctgcagtttactgggtatagtaatgacaaatcactgtttcaagagacaatttcaaaagcattagatgctgctgagagaggattgtgaaccaggggactgcccctttcttcttggagagcgacattgggagaatatgctctgtgagcccaaacagcatcctcccctgcagggtgagggcagagttgcagggcaggcccagaacccactccacacagatgtcagccctggagctgctgcagaggagtctgaggagaaaatttttccagcacctgaattacacttatttcaaaacaaaaatgcaattaaaaagttaaaacaagtaattaatgtccaggcacagtggcttacacctataatcccagaaatttgagaagctgaggtgggaagatttattgaacccaggagtttgagatcagtctgtgaaaaatagtgaggcttcatctttatttttgaaaataaaaataaaataaaacataaaaaatttagcaaaaactacgatgcgtctttacataccccatcatacttgaagcatttacctaacccaatgaggtgatgaggacccaatttgaaaggagaaaattttagacttttcatatatcttaatagttggaagatgtagaagaaatatatttatatcaattaaatgtgtgcaaatattgacagacacaccataccaggagttcaacttgcaaagggtaaaaccaaaaaagtttgagattgttaatgtgccatttgaaggtgagatcgttttgaggaccatgtcctgtgagagtttgtttctctattagaggagttctgtactcataaagttctggacatgccaggagacaagtatcagtaaacaaatatcagaacttgaacttcagcttcccactcttgcattctccatgtgtcatctctctactatttctcattctagatcaggtctttagctatgaaatattccacctaattaacatgtaaatagattgaagtccacagagttaaatatgtatattttctcctgtttttcccaattgttccctcccacagctccaatattctccactgttaccatcaccttctagatctgctgccatgccctgcagattaaggatttgattccatgacagagaggaggtgcatttcaatggaactttggtgagaacctcggtttttatcccatttcctctggggctccaccagtgcatctggaataatgggttcagtggctggcccctgcagggtgattccttagttctgtagtgaagatgagggaggtgggtctgaatgcatttcagaagtatgggctctcctctctcagacagacactttgggaaaataagatttttctgactgcacccattctagaacaaaggaattcaattggataagaatgctgataaaaaaaacctcaaaccaaattaaatttaaaggagtttaattgagcaatggatgattcatgaattgggcagcccccggaatcacagcagattgaaagagacttcagtgcagccatgtggttgaagaagatttatacatttttttaaattatgtacagaaatcagaagtgaggtacagaaacagctggattggttacaggctgatgtttgtcttatttaaacacagtttgcacactcaagagtgtatgagtggttgaggtatggctgctgaaattggccaacgctcagctgttggtgaggtgctcaggtacatactcctgagttaggttttcaatctcgtccacctattcaggtaggttaccgtttgtccacaaggactcaaacatagaagtacggagtcctcctcaggccatatttaattcactttatcagtgcccttcagcatatggttcctgagaatttcacacggcaacatgtttaccaccctagaatttaagcaatccaatacatgtaataggctgtatttcacatggcaacttctgcctcagtttagctaacactatggctttgtttctctctacaagaactcatttctcccaagatttccattttcctgaaaggaaaataaatctttgggacccccatatcactaagccaaagggaaaagccaagctgaaaactgtttggggcaaacccaccttccattctttccctaaaatgatagctgttaaggtgtttacaagctacatatctccttcaaaatttgaccgcacagaaaatccttgtagaccaaggacattgtagaccaagcagagagtcacttctctgctcacgtaagtcaaatgcatatctgattgctccctttgctctattgtttcactaagccagactaaggcctatgtgactattcctgtaaactgtgcattcagttaaaggctaatcggaaactcaaataatgcaaccatttctctcatacctacctatgatctggtagctctccccccaacttcaatttgtcctgcctttttgaactaaataaatataccttacatatattaattaatgtctcatgtctccctaaattgtataaaaccaagctgtgtcccaccacactgggcacgtatcatcaggactccctgaggctgtgtcacaggcatgtccttagtcctggaaaaatgaacttcctaaatctattgagattagtctcagatactctttggtttataagtatgttttctatctcataacttcaattatctgaaatactaaaggaaatctgccaaataacacattatcttgtttatctgttattgttgttgcaaaaataaatatatttatataatttatgtataattgatcatctttgtacattaccaaactgagtagcagatttgttagtaagacccaatgtaataaaaaattcaaatatcaattaacaacttaatagaaaaacaaattacgctacatttgtttgccgaaatgctaccaatttttataaaaaaataaacacatataacataaatggtttaattctcagtatttctattgagaaaaataagccaaatacataagcgaatatactatattatttcattcttataaattctaccaaataaatactagtctaaagaaatatgaaaacatcagtagtttataaagaaatggtagaaaaagggaaggggaaaaaacaaataatataaaagatcaagaggaatgctgaggggagttgacttgttacctcattgaaaatagagattattttttcaaagtttactattgcacatgttaaatatgtgaattttatcatctgtcagttaaaactcataaaatttattacaagtaaacagccgacattttatacaaaaaagggatgataggaagaaacaaataaatacattaaatgtcagatacgccaaaaacttatctgcctgacccctagttgtctccgtaatttttggatgaaaaccagcccacccctgaccctgctgctctgggagaggagccccagccttgggattcccaagtgtttgcattcagtgatcaggactgaacacacaggactcaccagggagtttgtgctaagctgggttttccttgttgctatattaaaatgtgattcatggagaactagagagattgagtgtgagttacatgagtgagagaaacagtggatatgtttggcaatttctgacttttgtgtctctgtgtttgcaggtgtccagtgtgaggatcagctggtggagtctgggggaggcttggtacagcctggggggtccctgagaccctcctgtgcagcctctggattcgccttcagtagctatgttctgcactgggttcgccgggctccagggaagggtccggagtgggtatcagctattggtactggtggtgatacatactatgcagactccgtgatgggccgattcaccatctccagagacaacgccaagaagtccttgtatcttcaaatgaacagcctgatagctgaggacatggctgtgtattattgtgcaagagacacagtgaggggaagtcaatgtgagcccagatacaaacttccctgcaggaacgctggaggaaatcagctgcagggggcgctcaggagccactgatcagagtcagcccaagaggcaggtgcacacagaggctgatttcctgtcagggtgtgggacttcgtctttttaccatttctctagggaacctctctaagttcagaattctgtgcttaccaatgtcatctctacatgttttttaatgattattttgagaacctattcttacatgcacaaaatgcagatggatgcttacagagatgaaaagtcctcaaccatggtcaccaggatcagccttgaggaaactcaggggtgcctggtgaatcttctccagtcagactcaggacagaaacctctgtgagattccctgactagatcagtcttcaggaattttgataccagccaatagagaggctgggccagggtcagtgtcatgtagaacctcacaggtttcacgtctgacccttctccttctcctgacactaaagtatgcaaatcagtatcagcactgatctgggtccccttttgctcttaaaccattctatttctttttatttgttgttgttcttgcttttcctcgtacttctcttgctccctgtaaaatggggaggtgtttcttgctgcaaaagccccaagcctcaagcccattccctgcagctcaggcggggctcaggctgtggctcctgcagccacatgggagtggctgttggggctttctcttctcccattgctcagcaccctccagtgtgttgtgtggagactatctgggaacgaatgtggacaacaggagtgaaggggatgagcttgcgtggacagaatgggatgtggatgtgaaatttatcctgtgctgtacaaacaaccacagattcaacttcctcaccagtagtattagaaagagggtgtgaaagttgtcagaataaaaatggaaacacttgtgttaacaccctgacaaatggaactaggaatgaccatgaagaagtttctcatgcatatactccagaaaacaagaactaccgtaaatggattctgcttaaccacagccttggatagaagaaaccacaaccttacaaaaatcacttctacaaggatatcttcccagcaactccctgtttaaccctacagtgatgccacccttagtcctacaaaaatcacttctacaagaatatcttcccagcaactccctgtttaaccctacagtgatgccacccttagtcctgattctaggagcacaggataatcctctcaaaacgacttatgtaacccacctcattttcactgtgtaaacctatggattcacatcctggagtcactgctgcatttgttcttaatggtcattagcccctttcacaatatttgaggctgtttttctctgatgtctcttctaaaataaagaatttccaagtggacagcagtaaagaagctatttaggaagatgtaatgggaaggcatctttaacattctgttgaatgtttccacatggcacttcaatcccctaaaatactttgctgtatcagcatgtgatgaatcggagtataatattgaaggtaaaatgggaaatacatgggcttttgatgaatcaagtcataggatgagaatgtctgtgtccttgaggaaggagaccatgggttgtaagttctagtggaggtacctttggcaaagggagttcatgagtttctgaaccttatgctacttttaatttaaggacgcaatttatgatgtatgtttacttaaatctttccagagacatttgtcagtaaggacagggtagcatttgtgtaatagtgatgacttagagagttattttgtaattgctcctgtaaggtatgcacattgctcacttgatacagaagttcaaatgtcacaggtggaaaaacaggaataaaggtgggcagatcacaaggtaaggagatggagaccatcctggctaacacggtgaaaccccatcgctactaaaaaatacaaaaaattagccaggcatggtggcgggcacctgtagtcccagctactcaggaggctgaggcgggagaatagcgtgaacccgggaggcagagcttgcagtgagccgagatcgcaccactgaacttcagcctgggcaacagagggagactccatctcaaaaaaaaaaaaaaaaagaaaacaggaataaagcaaattttatgaactgtcatgactgtagtttttggcaaggacattatcatgtcaacctgtaaataaacagacaacaataaaacatatcaaatccatggggagtctgacctatgtccctctgtcttataagcacaaggctttgccacatccaaaatattattcaggctccagggtataaaatgcttttggactgtggaaggtaacagctctcccctcaggcaggggtaaggtatctggggaatgcagagttgtgttcataaggaagatgtcattatcgtgtcttctcctgtgcctggtagcaggtcctgaaggtgaacgtctcagatgtcagacatgggtctatcgggttaggataggtacatgtgactgacagggactgattctccatgtaatcacatgccctgtcccaggagcagctgcaggagtcagccctggacctgaatagcacacacttaccctctgcctcacctacactgttactggccactccgtcacaaccagtccttactagtggacctggatctgccggctctcagggaggggctgcaatggataaaatccattgctagtggtggtgggagtccatttgtcttgtggaaaatggcagcatttccttattttataaggcataataatgctatgttgtgtacacataccacattgtctttatccatttgcccattgacagacacttagtttccatatcttggctgttgtgaatacagctgcaataatcacaggagcgcaggtatcttcacaaggcggtaatttcatctctttgggtatatttccataagctgcatcactggtcatatggtatttctgttttaattcatttaggagccaccacactgttttgcctaatggtaatgatgagaatacagaatgtcatagccgctacgaagaacagttttagatttgaggtataatccaaaagcaaataatgtttgatcagggttctcatatgaggctctaataaataagtccagaaagttttcccatcttgggcaaggatgagtttgcccctaattgtctttgaggaagaagattggcagaacgtgagatggagtctgttggcaggattcaggattcagtaataactagtaatggcacagaaaaatagagagatagagacatacagagaaagagagagagaatatgaatctcataagaggaaaatttgctaaatatcagcattgggttttcagtcatagacacatttgtatgagccaggaaccatggagtcaagtgaggagtggagaatatgttcagtccaaaaatcagcatattctcagaggcacccattgccccatcacacaggtggagaattttggaaaccagtgaagtgcgagttcacattaggtgattaagctaccatgtttcgataaactttcattaacatgcaaagtacttccatagataactgatgcacaaatatacgagatgcctttttgcgtttatggatgtctagagaaaaataagtgagaaaatttttccaggttgcagagatctgtttaagttgcagattccataggagagtgtctttgaatgaatactgttctattaattaaataggtcaaaattccctctgttggagcagccttccaattatatagatttctttatagcttcttgagttgtgaaacataaacccaaggattgacttactggaatatgactgctgtgttgattaaatttctgataaggtttcttccaatgatttgagaatagctttcctgtttttttactcaaggaaatgaattttcacaaggtctcaggacatcacgtttcaggtgctttagttaaagagactcttcttgggggcagtcagctttcttccaaccatgagctcatttcttcagcaaaccattcgctttgtgcctctattaagaattatgaagcttttgtacttcaatgcactgaaaatcatgccccttgaattaaatgttgattggcactgacatgaattggccactcttgtatatgtgtcctatgttatgggctcaacataacagtggactgagaatcgtccattagctgcctctgattgtggcactgaccagattgagaatcctcagagtcatccatgaaaaagagagtccttaggttcatgaggttcttggagacattcaggtaagtggaggagagaaacaggattgggggctgccagccatttcaacaagactgggaacaattatcatctatgtttaaaggtctacatcattccaaacaccctccaggtttctctgagttcattgtgatgattacattcagctgcttctccagtgagtttaaatgagcatgtggcaattcagatgagcctggctgtggggtttattatatgtaaatctgaactacataaacaaagagggcatgtctgaccgtatgagggtgcaaaatcctggagaccccacaccccacactcttgtgctttcttttctccagcaacctccaggtttttttgtatgagaattgtaatagattatctcatggctaagtcatcaagagacgtaaactctgagaaatacaagcagaaaattctccagatagaagatccaggggaagaacatttctagcaccttatctatgtaggggaaggcagtccatctccattacagacccctcacagcagccttcctttataaggaaaatgggtcaaattagccaatagggtaagaatcctataatgttccagccagaaaagggaaagcatcaatttgacttctggagactctgtatataggtcacattccatagaaagaagagcactaaattattaagattcaattgtaactacatatgatacttccgggatgcacaaattaaagatgaaagtgtgacaatgcacaggctctgtcagagaaggagaacgtagggaaactgaaagagaatggcagagagtaagacaaggacagaagagcaatatgaagcctctgacatcaactctgtaaggacaaggtcttggcaactcccgcattgaccacagattctgttaccatgggccatttgcagggttcctagctaaggaaaaagaaaaaaaaaactgcatgcacttcccaagtctccacttgtatcctgtttttcttagatctctaggacaaaaaaaatggcataaacctagacctagtgtcagtgtaggaggtactttctttataggcaagacactaggaagaagggaaaatgtgtgttattggactaggagatacagagatggctttaatctgaatagatctacacccgcaggtattctcgaatgcaacattcaactacaagagcctaatgaagaaacacgaccctccccaaacccctgcaagctcttgtattcactgtgtctccactgatttagtgcacctggagcttcagagcactggctccctcctgtgtcctagaatcttttctttgggtctttctgcagaattcaataggattagttaggctaatcaattgtttcaagagatggtgttggcagcatatattgtcgctggaagagtattctaagccaggacacaggcactttatgccggactaaagactctggagaaaatgttttgtgagccctgacagaaacctccttgaaaggtaagggctgggcaggagggggcactgaggagccacgcagcacacggtccagccctagaacaggaggctggggaggaggtttcctctcagggcctcggttttccttcgtcagaaaaaaaaaaatctaaaataaccgttcaacaagttgctgatatgccttcaaatatcctgctacaatggaacaattcatataacttcaggcaatgagaactattttttaaattgggcttctaggattataagtatcttaatagtgaaaatgtgaagaataggtatgattttactatttcaatggatacagaattgtgggagtcactatattcctatgaacaaaaaattcagatttcagtgttaagtaatgttgcctacattgtgtgagtgacggggcagtggtggatccgagagtgtggtgggtgcacggacataatgattcagaaagcaatatggaaagatgagtatctatggatacgaactgaaagtatgtaaatacttcacaaaatactaataaacggagttgaatataaaacccataattatccaaaacacaaatttcttggaagttattttgggaacatgatttcttaaagaactccaaactcttgtttcaacttctgactcctcgtttctgtgatataagaaaaccatttccaattatgcatctcagggcaattctgtaaacccagagcgtttctgctgaagatcctggggaatcaagacaccgggcaggtgatggagacactgtctcaggtgcgcccaacgaatctcagaggaacctgctggagagtcacgtggaacatctacagtcagtttctcagagtcaacagtgagctgtgttggtgcctgaggggaccatgatggggccaaggcacgtgcccagtgtcgtggacagtgatggtccagaaatgatctagatggtcttgacgctaatgaaatatgggttcagagtgaggagcataatctgtggggacttgttcttcagtgaaaggatcctgtccgcaaacagaaatggagcaggacatgcatttcttcaagcaggattagggcttggaccatcagcatcccactcctgtgtggcagatgggacatctatcttctttctcaacctcgatcaggctttgaggtatgaaataatctgtctcatgaatatgcaaataaccttagatctactgaggtaaatatggatacatctgggccctgaaagcatcatccaacaaccacatcccttctctacagaagcctctgagaggaaagttcttcaccatggactggacctggagggtcttctgcttgctggctgtagctccaggtaaagggccaactggttccagggctgaggaagggattttttccagtttagaggactgtcattctctactgtgtcctctccgcaggtgctcactcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagacacagtgtgagaaaccacatcctcagagtgtcagaaaccctgagggaggagtcagctgtgctgagctgagaaaatgacaggggttattcagtttaagactgtttagaaaacgggttatatatttgagaacaaagaacaatagaaacacaatctaattgtaagagaaatattccattcaagagccaccacataagccaaactgacagagtgggaaaggccacactcagtaaagttgatacaaacataccataaaggtgctactatgaacaagtttttgaattagatgaataaatcatttggagcaaggttatttggtcatatgttaagagtaagcatgattcttacaaagtgggaaaattgtctttcaaatgtttctgtcacttcttaccataaagttcattttagaggttttaggattacagtgaaattgcacagaaggtgtgagaattcccatgaatccctgccccgcacggacaccgcctcctccactacagccatcctgccccacagtcacaaataagtcacaatggatgaatctacaagaactcttggttctttctttttctggtgatcccctaatataacaagcctaaattatcttggaacacccaggtattttcaatggctttctagaagtgatattagtcagagggaaagtgagtgaggctattactatttgagcactttcttccaaaatccacaaaatatatgttaatttggagtttttctaacttctggtttacaatgtcccttcccagagagtaagatttttaagcttttagtgaggctggaaaaaaaaatttttaaaaaagagaaataagctttcctgtattaggctgacttatcccagcggcagcaacaagcacagcccagacccaggaaaagtcttaataatattatctaatgtgctctggagactctttcagcactccctcaacatagggagaagaaaaacaaattttcctttgtcttatgatatgagtttatagagtcttgttctctgtaactagtaacttcaagtattctgttttatctaagaagcacaacgaaggtcatgagaagcctagcaggccagaactacagctgtctaggtaccggagtgagtgttatgagatcaaccagtgcaaggctctttagaacaaaacctagataacagacatctgggttgcatagcaatggtcatgtgtaatcctgagttatgaacctgttacaatttgattaactgtctctgtcctgcctccgtatccctgcttttgtgcactctaagcttgcttcaagctagcccaccccattttgggaagtgtgtataaaagtcaagcgctctctttgttctgtgcccagtctttggtcattgagtctgctgggtctgggtgtactcagtaataaaaatatcctcctgtatacaccccaagatctctctctggtcctccggattctgcaacatttcaggcagattcacatctctaaaaggccagcaagttctggtcaatcccataatgaaaatcctttaatgagacttggcacacgtgacaataagagactccttgtataatgccctagagttggattagacacactgtgagctcttgggtggtggttctgaataaggcagtttgtgcagcaaatgcaaacacatgcatgggatccaggcaggaacaaaagcttccctttacaaagtgggtgggcatctggagggagccctcagaggtgggcagtggtcgtccttgctgactgcacattagccagaggcgtgaccataattggtcttgcagggaaagagcaccactgaggtcataggttatgaaaatgtttgtcatcctccagtgagcaagtccatcctgcttgcttgtgggtgtcaactccatggtggatacactctgggagatgacaagatgcacacaaacctcctctcactaattatccactaccacacactcaagaccaacctttgctccagaaaggaatacgtgtctgtggaaatagacagagcttaagtattttgtaacctggtgaacatactgtgcaaaaccaaacgtttcaggaagattagctcagaaatgtttatcaagtgactgaagggcagtggcgggtgaggtgatgggacagcctcagggctgcacatgaggagggctccctcccccatgcaggcttttcctccaggagctgcaccaggaactcaaggaagatcagggagaattctgagaacaccctgctgtggagctgcctagagaagaagaataaatgatgaaaaatacaactctgagtaatgcatgggtttttgttcatgaaaactctctctctgaaagcttgtgaaggtcttgaaatacccctgattagctgaagacaaacatttaaaccctccttccacagggagttcaagcaggctggatgtgtccttctatggatgatcttcctcagccccttcctcttcccagctcatccctggctctctgtgtaaaaagttctcatcagcggaatgtggttgatgaagtgacgtcttcaatttcctcatcttctatgtggtcatgttattttcctcatctgaagtttaaaaactcacctgcatgcagcacatgacaggctaaaatctcttgtggacaaaacagtaacaaaggcacccaccatggttgagcacccgtgttgctgacaacgaccaccaggggtcaacgtcctcttcacaatcctgtgtcagagcagcacttgagtgatttcaataacaacttcccaggagaatcagctgaaaactacttgtcccattttccatacagatataacccctctattttcctgaagaaatagaaagagctgaatgctgaatacactgaatgtctgctggttttgcaagtttgtgactatatcactttctaatttctgacctgtgcagaccactgtacagacttttctcactggtgggaccaggcttccagatgtcaaatataaatgagcttcttcatataaaagtcaacacaagctcctcatggtttcagtgctcactgaatggagttggaaataaaacccacaattatccataacacaaattccttggaagttattttgggataatgagttcataacctgtagaccaagagtccaagagtgtttctattgaagagcctgggggatcaagacaccaggcaggtgatgcagacactgtctaaagagtgcccagcggctctcagagggacctactggatactcacgtgggacatcagcaatcactttctcagagtcaccagtgagctgtgctggttcctgaagggtccaggatagggccaaggcacctgctctgtgtcggggagagtgattgttccagaaatcatagaggtggtctctatgcttataaaatctatgttcacagtgagaagtctgttctgagagggcttattcttcagtgaaaggacctctgcccacaaatgttcataaatggagcagggcattcatttcctcaagcaggatcagggcttgagtcatcagcatctcactcttgcaaggctgatgtgtcgtttgtcttccctttcttatcatcgaccaggctttgagctatgaaatgccctgtctcatcaatatgcaaataacctgagatcgactgaggtaaatatggatatgtctgtgccctgagagcatcacccaacaaccacatccctcctctagagaatcccctgaaagcacagctcctcaccatggactggacctggagaatcctcttcttggtggcagcagccacaggtaaggggctcccaagtcccagtgatgaggaggggattgagtccagtcaaggtggcttttatccactcctgtgtcccctccacagatgcctactcccagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatacacagtgtgaaaacccacatcctgagaccgtcagaaaccccaaggaggaggcagcttcactgaatgaggaggttacagggcttacgatgtttaaagttgttcagaaaataggctaagcaattgaggaatatgagtaatagaaatatgtacgcactctatacaggaaatatttctaataactgtcaccctatatgcaaaattcgcagagaggtaaaagcagaaatcagtcaagctgatgcaaagttccccacgtaggctttgtgcagatgtaagttctaaaatcagatagataaataatttggagcaagattgcttgataacatggctaatgctgaatatgattcctaaaaactggccaaaatatattccaatttgtctctgccacctctcttacataaaatgtattaaaaagtagttttaagaccacagcaaaattgaacagaaggtgcagagatttcctatgtgcccctgcttcacacatgcacagccttccccactgtcaccatcctgccccagagtcatcaataagttacaatggatgaacttacatggatggattggttctttcctcttccggcggtcccttggcataccaagtctaaactatcttgaagcacaacaggttcttcgagtgggttcctgggaatgaagccagttagaggaaaagtgggtggggctattcctattaggagtcttttttagaagactcataaaatgtatatgttcctatagattctgtgactcctgacttagtatcccttcccagacggtaagcttcctaaatgtttagaggcagatccatatctatggaaagaaagcaagttctagtgaatcccataaggaatgtcctttaatgagaagtggagaccttggtcatgaggcacatcatgtatgattttctataattcctttagattcactgtaagcttttgagggtgtttctggatgaggccctttgtacagaaaatgaaaactcaggcatgagttccaggcacaaccaaccaacttccttccaaagtgggagggaatagaagaaaccctctcctgtgtgggcgctggtccccctccattgctggctgcacattagccagaggcatgagcccaattagtcttggagggtgacagccccactggggttgctggctatagaaatgcctgtcctcttccagctgagtgagtcaacctgctcgcttgttggagtcaactgcatggcaggtgcactctggaagatgacaagatgcacacaaaccttctgtaaagtatcaattactacacactcaaaaccaaactgtattccagagacaggtgtctgcagggataaacagaatttaagcattttttgaatagggaagacactgccaaatgccatatgtttcaggaagtttaactcagaaatgttgatgacataactcagaaacgtgaggtgacatgacagcttcaggggctgcacatgaggagggctcacttccccatgcaggcttttcttccaggaactctaccaggaactcacagaagatgagggagattctgaaaacatcattctgtggtgctgcccagggaggaaaaataagatatgggaaaaaaaactatataaattattagatttgttaatacaaactatttctgaagccttgtggaggtcctgacataagccatcattagctgtgaacaaatatctacaccctcctttcctggggagttcagttaggttgcgtctcttcttttatggacagtatcccccaacccctttatttcctgcacacctgctgctctccatgggacgagttctcatcagtgaaatgtggttgatgtagtgaggtcttcacttttctcattgtattagtcaggattatctagagggagaactaacaggatagaggtctgtatttgacggggagtttttaaggaggactgactcacacgatcacaagatgaagtctcatgataggccgtctgcaagctgaggagcaaggaagccagtccaagtcccaaaacctcgaaagtcaggtggaaaagtcgtttattgggatagtacccactactacaatcagtaaatgttggatacgatcaacagcatggttcaattcacaagtacatatgatgagtatagtgagccaaagcacatacatatgattccgttttataaactgtacaaagtgaatactcattggaaattacataacaaagatcactaactgacttctccatagtaagagaagcgaaggtataggagggagaaattgtgagagacaaagagaaaattgagaggcgaattgatttgttttctctgtgaatggtcattaggtcaatgtttgtcaaatggtgaacatattgtgtgaagattatatgtctgtattacttcattaaagctattataaataaaagtctaatgtggtagaaaaagatgaagagagaaataaaaataatacaagaaaagtcatgaactcctgaatgaattaacccttagtttttctctattacttataaaaacaccaagatacagccaaataatatcacgatatcattataagaagagtgttttgtaaacctcactgggaatttatagctctttcctagagttaattttgggaacagttggatccaattgtgagaaatgcaggctggacactgagactggctcttatgagatgtgagctcttgtctatgtcacatggtccttccatacttgggggtttacattcacatctgtaaatgaaggaaacattgactctcaaagaacatatttcatgtgcatgtaaaagtatgaatgctagtgagaattaattacttatgaagtataatcacccacatccactcttggacacagcccactctgaggcatctgttacagaactcattatatagtaggagacatgcaaatagggtcctccctctgctgatgaaaaccagcccagccctgaccctgcagctctgggagaggagccccagccctgagattcccaggtgtttccattcggtgatcagcactgaacacagagaacgcaccatggagtttggactgagctgggttttccttgttgctattttaaaaggtgattcatggataaatagagatgttgagtgtgagtgaacatgagtgagagaaacagtggatatgtgtggcagtgtctgaccagggtgtctctgtgtttgcaggtgtccagtgtgaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatacacagtgaggggaagtcagcgagagcccagacaaaaacctcgctgcaggaagacaggaggggcctgggctgcagaggccactcaagacacactgagcatagggttaactctgggacaagttgctcaggaaggttaagagctggtttcctttcagagtcttcacaatttctccatctaacagtttccccaggaaccctgtcgcaatgtcctgcagcacctcagaccacctgtcctggttctatcaaggaagtttacctccagcacagtaaagaaaacaattgaaggaggagagaacctgcagatgatagacaatattcaaaactattcatatgacaagggattactatcaagcacataaactcaactgaactgcaaataacaatatgattaataatgggcgaataacatggataaacgtctctcagaggaagacatgcaaaggatagatagatagatcgatagggatatatacatacatatattgctagaaataactaatatcaggaaaatgcaaattcacaatgagctatctttccttaatctttgctggaaagtctgttagcagaaagacaacataaggaaaacaaaagctggccaggcttcatggaaatgaacacttttatagaccacttgtggaaatgtaaattagtacagccatcatgggaaaaaaaagacaactaccatataaatcagcaatgcaactgctgagtgtgtgtgtgtgtatatatatatatatataaaattaaaagaaaaaactaatattgaagagatacctgtcgacccatatttattgcagccctaaacacaattacgatatgaaattaatgtatgtgtccatcaaaacgtgaatgggtaaataaaacggggtatatttacacaatggaatattattcagccttaaaaatgaaattccgctgtttgaaacaacatggatgtaactgggaaccgttgtgttgagtgaaacaagccagacacagaaaaaaaaatacctcattttctcaatgttatgtagaagtttaagaaagttcatcttctagaaggaaatagtagagtagtggttatgaaatatcagaaatgggtggaggccgagagataagaagtggtttgttaacaaatgcacaattacaggtagacaggtgggatacgctctagtgccctacagtgcagaagggtgactacagttaacaatatattgtacactttatgtttacaagtagccagaagagagaattttgtatgctaccaagcaaagaaatgttaatgtctgagctgatgaattagctcgttgttctgatttggtcaaaccacattgcacagatgtattgaaatatcacactgtaccccataaatataaacaatcattatctgccaacttaaaaaatcctttaattaaaaaagattttatttgcatacattacaaatgattcaacacagagccaggaaaatataacatttttatttgaaatagttaaattcctaacaaaatagttacattctttggcaccaaactgtgtatttgatcatggtaagtatagacagacttatgcaaagaataatatattttaaacttagacttctacttaatactataaataaaaataattttagaacagctaagtaaaaggaataaagttgaggaaatgtgtgtgtggtgtgtgatgtgtgagctttttcttgtaaccacactgtccatggtggatgtgtggtgtgtgtgtcttgtgtcttgtttgtgtttcctctgctaggggttctctgtgattctaggatctgtagctccagtgtgtttcaaaaaattgggaacattcttagccattactttttcaaatacttctctttatctgcaatttctccttttcagaattaaaatatacatatactacactttttgatattaatgtttagtttcttcagtctctgttcctttgcaatttacattgtgaattttctagagacaatttaagtgcatggtttcatttaaaagctgagccagctctactgaggggtatgcccaaagtttgctcaatgtttatactgcattgcttttggtttcttatgcacttccatttgattctttcttaatatttatatctctcagttccctatctagtcctgcattatgtccacagtttcttgaagagattctcacatatgaattacaggtactatacatatcttgtttaatcagatatttctaatatctgtatcatttacaaatctcattctgaacatttgtttattgtgactttagtatttctcattaatataggtaataattgttgttgataaccagacatgttgggtcagacaggggatattatcttattatttcattttatccattttctgcctgtatgtgaccacactttatctgtgccaggcctttaatgtggaaatgtctgaatcttctcagagctacatgtgacatttacttgtggagtggacgtcagagttgaagtctgctcttctgtgcccgacagagacttcagatcctccagtgataccttgtttttctttcctgcttggctgtgtctctacacctgttccctcctccagagaatctccttcagttccttcaggggggttaagatgttatattcaactgacaattgtaaaattgtcatagaataaagggatatttagaataaagggatattttctgacctttcatgggtccatattgtgatcctgagtctgggtgtgacctttccattgtttctgaacttcctccagatgagatgttggtctgtgtgttcttgctgttttccctgggtgagagtcctcttgttttccccagttgttccctcccacagctccaatgttctcttttggtgttatcatcttccagatttgctgacctgacccatagattaaggctctgattcagtatgaaagggggaggtacttctcaatggaacttaagtaaagacctctttttccatctcattttctaagggattgtcccagtgcccctaagatcctggttttggtggcttgcccctgcagagtaatttcttagttcctgcaatggggataaaggaggtgagtctgaatgcatttcaaagtgtgggttctttttctctcacagacagacacattggcacggaaagatttttgtgactctccacattattgggaaaactgattcaagaggataggaaagctcttcagtatgtggtccctgagaaattcatacaacaccttttaccacacttgacttcaagcaatccaatatatatatgtgtgtttttctcttgtagtagcctacattttacatgccagactctgcccagttcagctcatatcctggccttgttactgcctacaagaacttgcctctccctgcatttcagatttgatgtttttcttaaaacttcaagtatttaaagtatttttaaaactttgcaaaatcccattttgctctgtttacctgatattgttgatgttgttattgtaaaaagtaagtagaatatattcctcatctatgtacgtttcaaaactgagttgcagctttttttggtaagacccagagtcataaaagactgcaaatactgttaagctgcttaacagaaaaacaaatgctggtaaatgtgttcactggaatactacccgtcatttataataaataaatgcctgacacacagaacaacataaaatatctaagtatttataccgagtaaaatatgccaaacaaataagaatatatactatgtcatttcattttttataaatgctgatgaataaaaaatgcatctgaagtaaaataatgaggatccagtagttgctgggggaaatggtagaagggaaggggagaggaggaggaatacagcagaataagaggaagtgttgagaagaattcacttgtccactttcttgataatgacgacagttacatcacgtttattaattgcacattttaaatatgtgaagtttattatctttcaattaagccacataaaatgtattacaagcaaatggaaatttagacaagcacggagtaatagaaagatccaaacatatgttaaatgtcagaagtatctgaaaattagtgtgtctggaccctagttctctccatattttcaggtgagtgctggtggcaacatcacacatgctcttactacagaaagtgggttctgaaaaccacaccaggcacgtccagctttgtcctggagttggtttagggggatgtcacagccagtgacggaggagcacagggccagataccagcgttcacttatcccagacatgaactcctggatgcatacagagccccctccacttgtgggtttacttccacttctgtaaaaggagaaaatattgactcctacagaacataatttacacaaatatttacagatgaaatagggtgatcagggcaaagtgtttatcacagcacaatttcataagacagcatattttccaaataccatcgtcagcaaacatctgcagggcaccgtcttattatctgggtacagcctattcctccagcgtcccaccctagagcttgttatatagtaggagatatgcaaatagggacctccctctactgatgaaaaccaaccgaaccctgaccctgcagctctgagagaggagccttagccctggattccaaggcctatccacttggtgatcagcactgagcaccgaggattcaccatggaactggggctccgctgggttttccttgttgctattttagaaggtgaatcatggaaaagtagagagatttagtgtgtgtggatatgagtgagagaaacggtggatgtgtgtgacagtttctgaccaatgtctctctgtttgcaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcagggtccccaggaccaccaggggcgcccgggacactgtgcacgggtctgtctccagggcaggtgcagttcctgctgagggctggcttcctgtcatggcctgcggcgccctcattgtcaaatttccccagggaacttctccagatttacaattctgtactgacatttcatgtctctaaatgtaaaacttttttgtcctttttgtttctttgtttttgtaacaggaggacacaccctcacctccacagaaaccacagtgtcactttgggggcagatgatccttctgtggtcagcaggatgaaagttccgaggaatctcaggggaacccgaagagtgtttgccagttagactcagggcagcgacctccacgggaatctctgattagaacaggctttgagttctgataggagccaagagagacgctcacacagggtcagggtccttaaagcctgatggttttcacagctatcccccctggtcttgtaaaactgtgtacatatgactcagactgattcacttgaccccctttctgctaatccattttccttctctgcatacttgattctcacaattccctttcttctcttccccgaaaactgaggatgtgttttctgtagtctaaattccagggctcaggtctgcaggacctgggtaggctacggggactttctcactcaccattgtctggactctcctgttgtcgtctgtgaacagagatgtttggaagatgaagtggacattagtcatgaagggaataatactagttttctccaatgggatactgatgtagagctggatcttgtgcttctcacactgtcacagagtttggactctcacccgtgactttgaggagagctgaggatggacactccattgtgctgtgagctctgggtaacaatagtagggccctggctaggcagcctaaggtcaatactgctggccttcaggaaagacaggctggaattcctgggaagacctgcatctgccgtccaccatggagtcccatcgtcttctattatgccctgattgaatcagccccacctaggttatctagaacactcttcgtgacttacgaaaaaataatgggaggctctactaacacctgtgttatgccatgggagcaacacctaagctagtgtgtgattgagtagatgagactgtggtctagtcaaggtgacacataaaattaattgttgccattataatattttattatatatttggcaatatagtcgtgctcatattataaatacttttgctacgttgttgttatgtcagaagcttttgaataagaacagcttcatcttgaataggggctaggaaaaataagactgagacctgctgggctacgttcccagtaagctaaggcgttcttagtcacaggatgagataggaggtctgcacaggatccaggtcataaagaccttgctgatgaaggttacagtaaagaagctggccacagcccaccaaaaccaagacagtcacgaaagtgatctctattcatcctcactactcattatatgcttattgtattgccttaacatgctaaaagacactccccctagtgcatgaccgtttacacatgtcatggtaacatcaggaagtttccctgcatggtctacaaaggaggggaggaaacctcagcttcaggaattgcccaggggactcatgaataatccatccgttgtgagaaatacattcatccctttgagagaaaatgcacagggggtggaatgaggctgggaagctgatggcacatggtggaagcctgtccctgagtgaaggagagggggaagctggattgggtggaaggtctctatatttgtgtgctgtgcaaggaagtgcaaaatataattgagttttgtgcaagtcagtgctgcctctcaggtgatccccatgactcccagaaatggctctgcttaggaatccctggggagtcagtcatttcattagagtagaccacaggacatgggcttcagcacacgccatgccacagatgtcagaaagcagctgctgggaacctgacccacctgcattttgctgcctgtaggaaaaggcagggaggtgcatcctcagggacaacacactgttttggatttctataaagaacgctgcttttactgtgttttattggaaaatacatgaacaaatgtgagcctgcaaacaattgtaattttcagttattttaattgcattcatttgtaattctgcatgatatgctgacacagagtcgcatttttcatagatattgttcaatgaatcaagaacatgcattttccactttcactggtttttctccgtgtgcagagaccttgagtagagcctgtctggcccttatccacactatctcttgtgtccccgggaaaaagcagagatttgcctgactgcagaatctggggtaggagtctgctcagctcacagcctgcagagaagcccagtgaagttttatggagtcagagagctttcccatgtggggaacctctagcttacccatggccagagattactggtcagctgtaattgagagtttaacaattagagcactcagaagcctatctcatcgcagcttcattatgtaacttaccaccattagactgcggtaataactcaatcttgatttttctgaccccattttctcatcttattcatttgtaaattgggttatagaaaatgttatgttttagactctgattcaaatctcagaagtttatgaactcatcaggaataatacaaaatgtgtctagttttggggaaatgtaaatgaatgtccatgcagtgtgtgtgtttgttgtgtggggatatgtcagtcacaccccaatgaacatgatttctgaattacatcatcaaactacaattagatttgctgaaaattgcctgcagtaatgtctgtgatgatgaacctgtcaccttgttgtgaggatgctcagtgcacaggcgaggttgcacaggagacatccaaggagcagcccccaggcttggcagaattcctggccaggagccagacataggactgggtgtctcaaaagcagattccccaaccccatccctttatttggactgcatgggcatcatgaggaccagcaggagatgctcagaactcactcaaggcagagcaccatttaggagcaggtgcagcgaggaaacagccagagaacctctgactagaagcttgggttgttttcttttgcttaagagcatccaagcctaagtatatcaaccactatatgtatatatataagtagactatccactatatatagagagagatagatataatctgtatatatatacagattatatctatctatatacattatatatacagattatatatatatataatctgtatatataagaaagttatgagttacagattatatatatacatttatatatatacatttatatatatttatatacatttatatatatacattttatatatattatatatatacagagcaaaacgaggttaatatgactctgccattaactccttgaacctgggtcattttttctgagaatgccgtcatctacagcatgatggttctcatgtcaaaatcaacacgcatagttagtcaccatgaagactgttttatctcatggtagaaatgtttatttaattaaaaaattacatttcatacgaaagggtctgtattatttctttctcacactgctgtaaagacatcacctgagaccgggtaattcgtaaaggaaagaggtttaatggactcacagttctgcatggctggggagcctcaggaaacttacaattatggtggaaggtgaaggggaagcaagtcccttcttcacaaggcagcaggatggagagagagagagagagagagaaggagaagcaggataaagagccggaaacttatcagacaaaccaatctcctgagaactctatcaggagaacagcgtggaggaaaccactcccacaatctaatcacctctcaccagacccctcgcctgacacttggggtttacaattcagtattagctttgggtgaaaacacagagccaaaccatgtcagaatttctaggtgagaattggtcaattcataagttattagtgaagtatcagaaaaataaatagcaccagtgttgttgttatccagttaatttataaaccatgtcaatatccattttatgagaggtgtaggaaaagtgtgagatggatagatagatagatagatagatagatagatagatctaccaaatacaatatatataactatattatatatattactatgtatataatatgtagtaagtgatatatggtatatatatatgacattaattctaccaaatacttcacatatgtatgtgcatatatatataatattaggtatgatatatatatgaaatatcaggacatatatatatatatatattttataatgtctcctgggatttagtgttgaattttttaatatctacatgtattccaggataaatgttggtggacttcataaaatatattctaatttttatgtgcaagatgatcactttcaaataaggtttagctacagaaaccagatgtatctttctaccagaaattactggaaagcacagtgaaatttcttaatcaggattttaagatgcttgacaccactcaacaaagacagtgattactaagagagagaggaaataagcataaggagccctccggtgaatgcaggctcagatacttcctcaaaggtgttgccaggctacagtgctggagtggaaaccatgtggatttagcattaataaaatggagctggaaacccatgtaggccaagaagtgtggataccacaggatagcaagtggattgcagaaaactgtcagagagtgaaccccatagatggcaggaggaacacccagacttgacagagtgcagatcagtgtgtagaaagcagggaaggttgtacgtgagaacacaccctgctgcaggaagctctccctaaaatccagagccatggtaaatatatgaatatacacttacaaactttaaaacatacggaaaggcaccataataaagtcaaataaaggaaaggtgggttggctacattaaaatataaaaagagtatttctgagcaaataataatacttatgaggggaacaattttattctaccatggcaaatgatttcagagaacaacattcgaaatgcttatggccataatgaggaagcttcaaacaagtatacgaatagaattattaccagagtggtagtaccagagccctcagctttctgatgaaaactgattcttattatgaaagctaattattattataagcttattattattaacactaattattattaattataatattatataattattataatattattatgaaagcttattattattatgaaactgatattactagagccctaagctaagtgttattaccagagtcctcagctttccgatgaaacaacaacgtctgataaaaattgtaataacccaaacatataaaatcaattcaaattattctaaggatgcacagtaaataaaaatcattgattgataaagtgtgctgctatagactgaatgtttatttccgccctcagacatttgttggaattctaaccccaatgtgatggtgttacgaggttgggccgttggtaagtgaatgggtcacctttggaagatgactaggccccatccaccctcatgaatggaatcagtgcccttgttagagactccagaaagctccctctcctcttccaccaggtgaaggaaaagtagaaagatggtcaactatgaaggaggaagcaggttctcaccagataccagtttcaaagcatgttggccttgcacttgctgaccttcagaattgtgacaaatacatttatgcttgatctgaaccacccagactattctcttacagcagctaaaacatcaagtctcagctagggcagtgagggcccacaatacttgagagacgagcatcaccctctcctttccagttcaggatgacagaagcttgatctcgggctgaactgacaagcagagagtccttcctctcccccagatcgcagttgaggccgtggtgtcagatctctgtggttgagagtgaattccagtctgtgatttcatggatgcctttcttcatctagttccacttatgagacagagattccatgctatgagttataggccaagaatagaggaaccccaattattcccacccagctcacctgtagggcagaggatctggagagctttctgggtgaggcacaaagagactgtatgagtccacccctcccatgcagtttcctgtacttaaagcagaggtgtccctctgacacagatgaaccctttcttccgcaccaaggcagaggcggttatatttttacagtggcagacagagggcataaaaacagaaatgcagagctctctctaatggatgtgactttatttgcagtaaaaggagaataatttcaaccctaggttttttctaaaatattataaatatttatggtaagttattaatagaaagctggtggcttcatgagagcaacacattaaacaggaatccactcatttcagcggacagaaggagaaaaaccataatttaggaataatgagctgggcactgtggcactgcctgtggttccatccacttgggagtctgatgtgagaataacacttgagcccaggatttcaaggccaacctgaaaacgtagctagaccccatttagtaaaataaataacattttggggtcaggacaaagttcaaaaactgcccctgaaatgaagcccaaatttaattgtgtaacactgtggattaatggatgacacaacagtgtcaccatgcctgctgtgagtgcagtgtaacacttggatgacatatgaagagatacagacacccaaacagagacatcagacagtgaagctgtcaaaggctgcactgccgagcgtcaggctttttatggaaaccgtgtgtacatctggaactgcacctgggaatgacgacatcaaccctttaatagtgtcggggaaagagacgtcactgaaatagacaaactaagggactcaagaaataaatagagcgattggttttaccaatacaccagagcgttttgggtgatcactattcagagtttctgaattgtgttacctaactgtcattcagaaaataattatgagatacacaaagaaaaaaataacgtcacgaatgtacaggaaaatttccagaaaacacaaactgtctttgagttggtacagattttggacttaacaaatggagacttcaaaacaattattataaaaatgcacaaatcacaaaggaatactatcctagaaaagttaaggaaggtatgatgacagtatctcaccaaaagttaatatcaataatgagagagggtttttgaaagaaagttatagacacgctaaaattaaaaacacagtaattcaaaactatatgtcagaggtgataagcagtatacttgaacctaaaaagaaaaaaaagcacacttagatatatattagtagatatgctatattcaaagaatagtgaaaattgcaataaaatgaaataagcttaacataaaaggtggacccagctagacaaatcaacatatgtttagtgtgaacattagcatgagaagagagaaagaaatatgtcacaaaaatatgtcataatataatgacagataattccatgatttttatgataaatactaatatacacattgaagtatgaatagctcaacaaactcaaggtaaaataagttataagagatcctcaacaaaacacattataataaaatattttacagaaaaactactgagaaaatcttgaaggcagtgagagaaaaacaacttctcatatacaagataattctatcaacagctgatttctcatcaataacagctaatgctaaaaggcagcaggatgacatattttccctttgtatcccattttatcctcaaaggccacctgcatacaaagtagaccagtcttacaagaaaatcacagccctagtgttcttctctcaaggagcccggctatggacctaatggtgccctccccaaagtcataagtataattcccaacctgcaatgttacagtatttggaaatgagacttttgaaagtgatagagtttgaatatttgtcctctcccaaggtcatgttgaaatgtaatcaccaatgctggagggggggcctggtgggaggtattggataatagaggcagatccctcaagaatggcctatgcaatccatgtggtgatgagtgaattttctgttagttcgcatgaaatctggttgtttagaaaagtctggagcctcctccatctcttctcttgccctttcttggccccatctcttctcttgccccttctcttgtcatgtaatgcacctgtgtgcctgctgcctctttgccttccacaatggttataaactttctgaggccctcacaaagcagatgctggcaccacgcttattgtaaagcctagcaaatggaaagccaaaatgaaacctgttttatttataaattttccagcctcaggtactctttcctagcaatgcaaggacacagcaacacagaaaattggtatcaagaagtggagcattgctattaaaaatatgtgaaaatatggacgcagctttggaacaggataaccgtcagggatttggaaggtttggagggctcagaaaaagtcaggaagataaagaacagttgggaaagttttagagactggttaaatggtttgaccaaaatgatgaaataaatatggacagtgaagtcaaggcagagaatgcctcaaatgtaaatgagaaagttatagggaagtgaagtaaagatcgcctgtcaagcaaatcacttgactgcattatgttcatgtcctggggatctgtgcaagtttgaacttacgagtgacgacttagggtatctgacagaaaaaaaattgtcagtagcaaagcattcaagatggagtctgcctgcttctaacagtctaaaatcaggtgcagaagtgaataaatgacttaaagttggaacttctatttaaaagagaagtggaacatggaagtttagaaaatgtacagcctggttctctggtaaagaaataatccagttacactgtgaagcaaccgcttgctagaaagattagcttgactaaaaaggagctgactgtggtaatacgaaacaataggaaaatagtcttgaagtcaattcagaaatctttgaggccaattctctcattacaggcttaggtataggagcagagaatgtttttgggggtgagaccagctagggctcaaaggtacagctcggttcaccacgtctgatggcgcaagctgtgatccttggtggcttccatgtggcataaagcctgggtctgcacagtatgcaagagtcaacatggcttggtgactggcctctagatttcagaggatgtgtgagaaaggctaggtgccagaaatgagcctacctcagggtcagagtacacacagagtaatttttccagggcaatgctgaggtgaaatgaagagttaaatcccccaaaagagatccccaggagaacactgtgtagtggagctgtggagagaaggtcactggccctctagaacccagaatgggagatccaatagcagcatgtgccccaagcctagaaacgctgaaggcactcagctctaaactgtgacagcagccgtgttggctgcactgagaaaagtcacataagcggttttgctctcagacttgcgagcccataattgcaccggctgcaagatgtggagtcactggtcactttggaggcttaagatcgagcgcctgtcctgctaggttttaggcttgcatagagcctgttactcattcatttggcaagttcctctcttttaaaatggagatgtttacccaatgtccgcaccaacattgtacctttgaagtaaataagttctttctaattttacaggctcacagatggaagaaatgtgggcatgaatcttagacaagactttggactttaatggtgaaacaagttcagatttaaggggcagatttcgaggggtgggtattgggaagaaaatgatcccattttgcagttgagaaagatataagattttgggtgataagagttatgtggcttccatatatgtccattcaaaaatctcatgtttgactgttatccccaatgttcgttggggttttgcgttacgggggcggattcctcctgagtggcttagcgccatccacttggtgacgagtgagttctcacatagttagatcactcaggatctgattgtttaagggagacgtggatctccccctttccttctttcccctgctcaccatgtgacactcctgcttcccctgtgccttttaccagaaatataaggtttttgaagccctcaccagaagcagatagcagaaccacacttcctgtacagccttcaaagcagtcagccaaattagaatttattttttataaatttctcatccccaggaatacttttatagcagttaaggaatttctataagaaagaaagtactgaatttaaaggagacgatgagggtgaaacatcagaatgaaattactgacctcaggagtaaagacaccagacagtctctctctctctacttctctctctctatttctctctctctctctctctctctcacacacacacacacacacacacacatgccctaaatgaaaagatcatatgatcaagtaacaatatgatggctgctctgagccaaaagtagaagcctcaaactaaacctatcttgtcagcatcttgatcttggagttcacagcactgataaatggaataaaattaatgttgcacgagtcaccaagtatgacagtttgtaatggcagcttaaactgacgaaagaaaatttggggttaagaagaggaaatctgatgttacaattatttgaacattgtgaaagtagcttggaattgggttatgtgtaacaggatggatacctttgacatatatgaagaaatttgcatattgagggtcatgctgatagacagaaatgagtggttttggaaaatggagcaacagtcatccttatcataaagttttttaaaaaaaacttggctgggcagtgatataatatttagtgaaagagaagttgtgagtagtgagaaattgtgagtagctgagaatagttctaagtgttgaagatattttgcttgattcctcctgagtgcttaaaataagtgaggtagataaattaaaatcagaaaaaaataaaagaaaaagaatacaaaagctgagggcttagaaaattcacaacctatccatattgcaaaaatcagaaactgtattctacaaagaacactgagtatatggctcaaatatcactcagtaagaagcttaagatactctatgaaaagaaatatttcaggttttaaagaatgagaattgacctgagacaaatttgatgaatactgttagatttttcagatttaatggcctggaataatagagctacttggctgcaaatgtacacaattcttccagaagagagaaaaataagctttaaatttatttagaaaccatcagaccactgcctctatttcaacagaccagaaagcctgtttctaaaatcttgaggaagaaaccacccaacagaggcttgggttgggagcacccagcaagccctgtgtgtagggctgcatgaggcccttgacatgggagctgggcctagcagtgcctcaggagcggtgcctctgcctgcagctttggagctgattctgctgctcgaataagctgagaaggaaaaagaatgtttcagagaagattacagtggaggcttaaagcatatggaaatttgttttcctatgcattgtatttgctggagacaaaccacccattttaccccctatttttttctttggcaatgaagctttctattctatgcctaattcaacaggacacagcagcggctgtatccagtttgacaagattcagcatgaaaggttcctattacctgtgccggatgcatcactgatatgcggccaccagtttcttaggttcatatcactttaagggaccaaatacaaatgtcaatagcatatgtcattcttaaactgcagaaatggtgtcaaagaagaatgtggagataagagagcaggaggaattatgaaaatccagatagcatcttctcttctagagtggaaggtacactagtaatttcatgaaacaataaaatagatgaaatgtgtcatcatcatggagtgtctcacagtggcagtgcacaaataaatttctaaaaattccataaggtaggtgtgatggatgaggcttatttccacacagggagcccataaatacccagataagtaaaaaatccaacacctggaacgaaaaatgcctcatcttgacatcacaaacccatctcagtaagtccgaggagtaatgtggaaatgaaacggaaaattcacaaacacatttattgtgaaatttttagcacatgtttgaacattaaaacagaattgtccacaattttaggaaaaccactccatgacaatgagtcactacactcatagaaacaccactgagtcaacagagttctaactgtcagcaggtcagtactgaggcctcaggagaatcaaggctctagggtacattttacagaacccagaattgagccacacaatctatagccaaatgatctttgacaaacttaacaaaaattaacaaaaatatacaccagaaaaaggacaccccattcaataaatggtgctggggaaatggaaatgaacatgcagaagaacaaaactagacccctaccctcaacacatacatactcaacacaaaatgaattaaagacttagatataagacctcaaactataaatgtactcaaataaaataccaggacaactcttctgggcattggctgaggtaaagaatttatgactaacaccccaaaagcacacccaagagaaaaatagacaaatgagacttaattaacctaaagagatatttcgcagcaacagagtgaacaggcaagttgcaaaatgacagaaaattttcgcacaccttgcctttgacaaggaactaacatgaagaaattacaaggaattaaactatacaacgacaacaacaggaagaagaaccaaataaccctattaaaatgagcaaaggacatgagtagacatttccaaagaacacatacaaatggataataaatacataaacaatgctcaacatcactaaccattagggaaatgcaaattaaaactacaataagatattatcttacaaaagccacagtggctattattaaaaactcaaaagtatcagatgttggtgaggatggaaggtaacaggaactcatctacactgtagatgaggatgtggacgaggacaacctctatggaaaatagtatggagtctgcccaaaaaactggaaatagaactgccatttgatgcagcaatcccaccactgggtaactactcaaaggaaaataaatcattacttcaaaaagatatccatgcttctatgtttaccacaaaactattcttaataacacacatgtcaacctgagtgtccaccaacagatgattttataaaagaacatagcacgtatacacaattcaatactagtcaaccacaataataaatgaaactgtcttttgcagcaagatgcctagaactgggaacaacataattagtgaactaactcacaaacagagagtcacatgtcacacattattatttataagtggaaggtaacaacgtgtccacaaggatatggagagagaaatgatggacaccggagacttagaaggatgggaggtggaaggtgggagcatgaggagacattacctagtgggtacaatgtacattatttgggtgagagtacactaaaagccaagaccactgtggaatatatccatgtgcaaaagttgcactcatagcctttaaatttatataaataaatgtacaaacaaaaaaattaaaaatataaaataattaacagttgaccaatgatcttaaagttaaaatttagaccaggcgtggtggctcacgcttgtaatcccagcactttgggaggtcgaagcaggtggatcatgaggtcgggagtttcagaccagcctggccaacatggtgaaaccccatctactaaaaacacaaaaattgaccagatgcggtggcaggcacctgtaatcccagctactcgggaggctgaggcaggagaattgcttgaacccaggaggcggaggttgcaatgagccgagatcatgccactgcactctagcctgggcgacagagcaagactccatctcaaataaaataaaataaaatgtaaaaaatgatcaataaatgaaattactatcagttgaaactcattaaatttaaagacattttctactcaagtaactataagaacatgaatgtcaagtttcagatgggaaactattttcaaatcagataaccaccaatttaattataataagaactctcaggactcaactgtgaaaaaaaaaaaaggaaggaaggaaggaaacaccccatggttaaaataggaaagggttggtgcagacatttcatcaaataggatgtgcaggtgacataagcatttaaacaggctcttaacaggatttcccattaagggaatccaaatcaggcccacaatgagaaaccactatacactttttagaatggctgaaattaggaggaaatacaggtaataccaatgctgatgagcataccaagttcctagtgtctacgacattgttaatgggactgcaaaatgaaacagctactctggaagataatttttagttttttctgcaatcaaacatgcccttaacacatgacctaaatatcccactcttgaattttgcttcagagaaatataatcttatattcacacaaaacctctattcaaatattcaagatattgcgtgtgtgtgtgttagaaactaaaaataacataaatatctcaaaatctgaataggtgaaaaaactaggaagcaactataaattgaataccatcagcaataaaaaatatcaaatgatcgattcacaaaccattacaggtggaactccaggcattacgctaagtgagaggaagccagtctcgactatcaaagggacacagctgtaagcagcacggtcatcctcaggtgtcagtggtttgggctgggctttctttgtctctttcctgaccagacccagatgttgagctctgccacttggagatggaaaattctactattttcaaccatgcactgaggtgtgaattacttcacagactgaccaaacaaacatgggctccactgaagagtgtctggcatttgtttcaaccacaagagaacttttcccagctcttccatgtccttggttctctcctgcaagccaggagccctggagtgtagcctgcatctcccatgtatccacccagctccttccaagggtcttccaccacaccctccactgtttgtgagagcactgggaggctttcaatttttccacattctgttgttactgaagttaggatgtttaggacttattaagatcatattttatgactgaatttcattgccccctctctcctgggacagagctcctaaacaaggttctgcaggtgtagacaaagttgagctgttttattcctcagcctaggagctgagcgctcagtggagggtcggagaggagcttcccaccttctcagcacttcggttatggtgggggagaacctctgccataggacagagctaggaaccagagacccaatgttcccagtggcgctggacccaggggagagcctccatccatgagtggggctctatggaaggagtgagtctctggctctcagtagctcttgtccagcactgaacctcagcatcatgtgctgtgggcagggtcagagggccaacgtactgccccctggggaagagtttcctctggtgggagttggtagaaggtgccctgtcttcttggctgcatctgtccgcagtggagtttacatcatgctgagctgggatgtggaaggaaggaagagcaccttagatcaaatacgatgactggccttactgagttttctatattttcttaaataaatatttcttcacttgctttatgctgttagatcctttccaaaccctgtaattttttcaaaataattttcactggtctcatgagggcatggattcattgagcccctcatgctgttaaagagaaatagaactgtttttttttttcactttttagcgaacatccatgggttataaaataattagttgacatttcttccaacactttacagataccatcaactttcctcttgcttgtgaggttttaaccagaagaatgctatcatcatcttttctgttcttttggaaggaatgccccctctactcacctccacttgcctgcatatatttctatttgtctttgcttttcagcagttttaataagatttacctaaatgtgtgtgggggaagcagggggtgttattctgttgttctgtgttctctgagatgcatggattcaccatttactctgcctccattttggggaacacagttagaaaaaatgtcagtgtgagcccagaaacaagcctccctgaagggggaacaggaccacccgggggcgctcaggacccactgagcacaagagccagcctcagggcaggtgcagacgggggttaaggtctggtttcccgtcagccctgtggcttcctctccataaaacagtttcctctggggcacttctctggattccttatcctgttcttcctattcttcctgaagaagaaacatttgtcgtaacaagagaaaaattttctcacatgcaccaaaggcagagtcacctacagtcacttattccggtttctcaatgtgaataaattatcaatgcttctgaatttaatcagctaaacctattaaaggtgcggtgtttaactcaacactgccgccagctcaacagaactccaagggtcagtgagcaggagggaggataaagggcatgctgggcactggggcagagggagttagcatccagtgcaagagaagaaaggccccgtggtggtcactgtcaggacttcaagcccatagttccaattgtaggtgaccacgttcaaaagaagagagacctcatccatgattagtgtgatgtgtcaagtctgatagtgccacactcacacctcaggtgattatgaaaagatttaccaactctactattgtctgctgagagcagcacaggcctctcaagaaattccaaactggaatttcctcaatggaacaggaaaggaggctggcttagggctttataatgatttggtggtggggtcggggggtcatttattctcaggagaaggagcttgtgtgatttaaacctcacattggcatcagatgagggagcttctacgatttctgactagatttcccatatgtgggggacaagggagaagaagaataaaccttaattcatcagcagcaagcaccaaaataggacctgacactttattctccctagcagcttaagaaaatgagtgaaaaagagagatgagggtccactgtgtgtgaaaagcaaacagaaataaagaaaataaaaatttttattatggtaagcacataataaaaagaaagagaagaaggaatgagacagacagtggtgctgaatcaatgtcctgggtggggccttttctattatccactgtcatcagtttattctgaaggtctcaggtcagcttcctgcttcaaactatcacaggcccttatagggtatataaaaatccttataggatatccacagtttgtcatactttactaaagtagtctaataattagatgaagttctgaatttaatattcagttataataaatattaaaaaataccacaatctacaaattaggaaaccgagactatatttttatcaagggttacagccatcccatatgctggaaagcatagttttggtaaagatgagagacagacactcccaagaagaaggagttgggcagaagatttatgctgaactgtttggctaaacagacttagtcaacaggttacagagaggctactgatgttcatggaggtggtgctgacacatgcatactgaacacacatgcatttaacatgtgagtcctgttcaattgccagtggtgacttagcatttaaattcattacagtcaggccctatgtgcaaacagcagaagcagagacacaaaggcactcagggtgcagcctctgtaaacagccagagccaggccatggtcagcggtctctgatcaggagaaaggtcctgatatcaaatgttcaatcaaagctggggttatggcttgtggaacagggggtcagttcagcagggatgggctgcaattgtcttcatagtgcttgtctcagtgccagtgcttactgagccaccagagaaaacgaataacctattggcagttagaacatagtttatcttttaagtgtagaagtgagtggcaaaatcctcgtctagcaaggccttaggtcttgtttataatttgacatcttactgccactgttctgtcagtcttatgatttctattttaacataagtgttggccattgctgcgtctaaaccacaaagggaagaaggtataacgaggcgtgtctgatctcttgtttagacatggttggaaacagtttttggatttttacggggttccctaggccaagagatggactatttaatcagtcgtgggttttagggatttatttttaggttacagtttataaatatgaacccaactattgactttctgcaatttcactgctgtgttgtggttaaaagtacctgataaaattccttccaaagtggttcaagagcaatattctaccctgatgtttcttacaatagatataattccctgctttaatgttattagaggctattgaaaagatgtagggaaatgatggtttaatctgttgatgaatagtgtgggtaaaatgcagtcatcactttcaacactttgtcatgcatgcatgtaataggacagaggtgagcattgtgggtaaatctctaaatgtatgggccttccagctaccaaataataggctaataactgatgtctccctgaggggattaactataaggctctcttgctagggagagaatctttggccaaggaagttcaagattttcttaaggtttggacaattttagtttaaggatgacaattttcttcaacattttcagaagattgtggatgggatggatgctatgttgtatacataatgctaatgccttccatatttagataatattataaacccctgactgataagactgcttgcttggtgtgatgacccactacaatatgtatactttcagttggtatgctatgtcattttccttcaggtttttactttccaagttacattagtcaggtctctaaaatgcaggactgcatctaaaatgtgttattttgttgtgcattttcacatgttccagaaggtgggagaaatttctttgtgtgaagagcatcccaaagtcaggcactcctctagaacacgtgtttaatccttgtctttggcttattgatgagctctgttgactgcaataacttctgccatccgggctgacttgacatcacatagaggaacaaattctgaatgaaagtttgctctactcaattgagtgcataacctcatttcattactgatgtataatgcatcagagataatattagatcaaggatttcaatgggaatctaatctaaaagatgtaaacaaattttcataatttagataaaattactgtgagcacactgctgctattcagccatgtctcctatcacactgaatccacactaactttgacctaaaagttagcatttgttctaatgttcagaattgttatttttatcataacgtctctagatgattacagagtgtggctatgttggccatcagtaaaggaaagctattttaactgaatgaaaatgagacaaagcacacaacctaatgtaatggaagtcaggacatgagtgtctccaggcttttgtgtttcaagagttcatgcaccaggggatttcttttcttacttgtacacagagcaacacccaaaatgttcatttcctctcccatcgactcttatcatctgtttctatgtcagttagctttgaatttttgaccccagctgcattcaagtagctgcaaataagcgtgatttcattcttttttatagctgcatagtattccactgtgtataagaaccacgttttctttatccagtctataacggatggacatttaggttgattccatgtctatggtactgtgaattgcacagtgatacacacgtgagtggatgtgtttttttgttacaataatttgttttcttttgggcatatacccagtaatgggattgctgaggggaattgtaggtctgttctaagttatttgagaaatctctagatcgatttccacagtgctttggccaagttacattttcaccaaaagtatgtaagtggcgcttttctctatagccttgcctgcatctgttaatttctgatcttttagtgatagcaattctgacatgtgttagatagtatgtgattgggttttgatttgcacttatctgatgatttgaggatgctgagtatttttgtatgttagttggccacttctatgtctgtatttgaaaagtttctgtgcacgtcccttccccatttttaatggggttatctgatttatgctgctgatttaagttccatatagattactgacttgcacacacggagaaagccagtattcccaactaaatagaaaaacataatcacttgtaggtatagacatactgaatttggaatggtcatggcttgcatgttggtattgaaatgggacagcaactttggaaaatggtcttcactgaaaatctcatacacaagtgtacctggtgtcaccacttacagtagttgaatggagaatacaactcaagtgcccatcgactgccacagggatgaagacgccgcggtgtgtctgtgtgtctctaacccacagggatgaagacgccgcggcgtgtctatgtgtctataacccacagggatgaagacgccacggtgtgtctgtgtgtctgtaacccacagagatgaagacgccgcggtgtgtctgtgtgtctgtaacccacagagatgaagacgccgcggtgtgtctgtgtgtctctaacccacagggatgaaggcgccgcggtgtgtctgtgtgtctctaacccacagggatgaagatgccgcggtgtgtctgtgtgtctgtaatgcagctttaaagaggagtgaagcactgacataggctgcaacttggatgagccttgaaaacattgggtgactgaactgagggagacacggaagtctacatccctaattgtcccattgacacgaagcacgcagagcaggaaaatcccagatcacaggaggtcaggggaagggaaacacagagtgaccgcttaatggaggtgaggtttccttttctgtgatgaaaatgttcccaaaccaaatagtggaaatggttgcacagcattgtgaatgtgtaaagtatcactgacccatacacttaccaagggctgaaatggtaagttttatgttatgtgtatctcaacacaataaaaatgagtgccacattttgtttagcatatcaatgacaataacagttcaggtgaatgctggattcctcatcacaaccagtgcttcctgatggagctggattcaggggagggactggagtgggttgggtgcacaggtcatgaaggcagcaaaaattccaacccactcctcaagagtccagtcgccacctccagatctatgtccgccggggcagctcttcctatggctgagctacatgagcaacaagcaaataaccatgttttttgttgttgttgtttagttttgttttgctttgtttttagacagagtctcgctgtgtcacccaggctggagtgcagtggtgcgatctcagctcactgcaatctctgcctcctgagttcaagtgattctcctgcctcagcctgccctagtagctgagactacaggcactcactacgacgcccagctaatatttgtatttttagtagagacagggtttcactatgttggccaggctgttcttgaactcttgacttcgtgatccacccgcctcagcctcccaaagtgccgggattacaggcgtgagccaccgcgctcagccacaaccatgtatttttaagcaaaagacacagtgaggggacatcagtgtgagcccagacacaaacctccctatgcgggttcacaggacagcatggggtgctgaggacagaggtgggcactcaggaaccagcagggaaacccagggggcgcttggcacttcatgggggctcaggaccattgtgggctcagtggtcaggcaggctcaaggctcagcctcagggcaggtgcagcaggcggggaaaggccctggagactgggtttagtgtcaccttctcattgcgccactggacaccctccactacatctattctaatgtgtatgagtacttatgagtttagaaaataacattgatattataaatctatagccatatgtgggtgcatcaagttaccctcttcaacctatgtggaccctgttcatcaggaataagtccctgcatttgaggaccttataaatcaataattatgtagaatcactttctttttcagtctcatttcctccctctttctctctctcacacacactgacaaacacgctgggtgctataactttaattacctgatgtgttaaaaaaaattgattcatttggaacttaaccagtttagctgttgttcacgctgttatgtaaaaaagatccctaaatgacttctacctggtaagaggagggaaggcgttggaaggtgaaattgcaggagaaggagagaatcgtgaaacggagtgagttgttttctctatgaatggtgattaggtcaatatttttcaaacggtgaacatattgtgtgaagattatttgtcaatattatctcattaaaactattgcaaataaaagtgtataatttggtaaaaaaaatgaagagagaaataaaaataatacaagaaaagtcatgaactcctgactccacacgtgagttaaccctcagtttttctatgttacttagaaaaacactgagatacagccaaataatatcatgatatctttataagaagagggttttgtaaccctcactcgaaatttctagctctgtcctagagttaatttagggagcagtcagatccagctgtgagaaacacgggccagacagtgagactggcttttaccagatgtgagctcttagacatgtcacatggcccttccgtgcttgggggtttaccttcacatctgtaaatgaaggaaactttgactcccacagaacataattcatgtgcatctataagtagaaatgctaatgagaattaattatttatgaagtataatcactcgcatccactctgggacacagcctactctgaggcatcccttccagaagtcactatatagtaggagacatgcaggtgggtcctccctctgccgatgaaaaccacccagccctgaccctgcagctctgggagaggacccccagccctgagattcccacgtgtttccattcagtgatcagcactgaacacagaggactcgccatggagtttgggctgagctgggttttccttgttgctattttaaaaggtgattcatggatcaatagagatgttgagtgtgagtgaacacgagtgagagaaacagtggatttgtgtggcagtttctgaccaggtgtctctgtgtttgcaggtgtccagtgtgaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagacacagtgaggggaagccagtgagagcccagacacaaacgtccctgcaggaagacaggaggggcctgggctgcagagggcgctcaggacacattaagaacacagtaaactcagggaccaggtgcccagggaggttaagggctggtttcctttcagagacttagctgtttctccatctaacagtttccccagaaccctgcctagatttgtgatctgtatctgctcaaactatctgtgtcaccttcctcacctgtgactttgaggaagcttagtgtggacattccagtgggtggagagatcttggtgacagcaattgtgtgttctgtctaggcatgtctatggctggccatcaggaacgacaggctggaattcttggaaagaggcacacctgccatccatcaggaaattttgttgtcttctgttctgctagaattaaatcaggcacgcccaggttaactactactatcttcctagcttgagaaaattaatggtgggcttgaataacacctatatgaaatcatcagagcaacacctagattcgagtctcatttaataattgagactatgttctagccaaggagacacataaaactggtgattgccgtggtcagttcatatcatatatttgtcagtagaatctggctggtattatgaacagctttgccaacacatgtgttagtgttggtcttcggagaagcacattctatgaatccattaggtttatgtacagtttcctaaggaaccggtccacgcttttgagaggaaacgcagagcgggtggaaagaggctggggaagctgaaggcatatgagggaagttggtccctgagtgaaggagagagggaggataactcagtggaacttccttaaactgtgctgttctaggaaggtccagcaagtcactgtatctgagtcatgtcaaagtttcccatcggggacccccgtgactcccagcagtggctctactcagatcagcgcggagctcattgttctcctgagagtggagcacaggacgtggccccagcaccagccgtggcatgcacatcagagtgcagccccaggcgcatggctcaggtgcactgtgctccctgcaggtggagggagggaagacctgactcagaacccatatgatgtgggttccatacagaacacaacttttacttaatttctgtagatgacatagaaataaacatacagtctgtaaacaatggtgattcctacatttaccttgagagctttattctttgattctgcagaatgtcctggcatggtgttgcctttctcatgtggaagtgtaacataagttgaggacatgtgttccccactttcattgttttcctccatgtacagagatcctgagtggagtacagctgaccctccttccacactgttcctctcctccccacgggaacagcagataattacctgaggctgaatctgaggtgggatatgtcctgtgcacctcagagcctgcagagacccccggctgcagattcatggagtcaggtgtttgtgcatgtgggaatctcgagctgtgctgttgtcagtgaatgctgcttagaactaattgcaggattcagaattaggagaccccctgatctatcacacctcagctcattctgccactcatcatcttcagaaattctgaatatggttcagtttacatttttgtgatgtactgttctcatttcatttagtcatgagtttggtcagcagaaagtgctaccatttatgtgtcccaacctgatgaagctaatttgcttcacgagaagttaggaggctcctgaatcttatcctaagcctgtctctctgcactttcctttaaaattcagttttacctggaattctgttgtgttgatttagccagttttccccatactgagtgtctgattttcctggatatctgatcagtttccttgtccttcaccataacttgggtgacatctgatcaccctggtctaacttcaacaaaaatcctggcaggctgccctaagcaggatttacctcactcctgatgtttcttcttggtgattttccatcctgtgccccaaccctgctgtatgcctataaatcctcacgttctcattctgtatttggagttctgctgaatctctcccccactgcaaaatcccactgccctggtccctacacctatcatgagggccctggatgaagtcttccttactgtgctggaacaagtgtcttcatatatacattttttctttaacaaatcaacctttagtatttcctaattgatcaaaggacctcaaacattgcatgaaagcgaggatctccattttactataaggggtgttgtgtgaatttcagtttccatgtgtggtgtccagaagtcctgggcaccaacggttgtgcttctctgtccaattctgtgattctgaaacccgggagtcatctgaacatgagtaaataggtgacttttctcactatttagtgactgccttatttcatttaccctgaagcttcacgaacacattgatgaaaagtagatagagaacttgtttggaaatgcaagatttatagtagacgtaaccacctacatgattctggaggtcttcttagtgttccaagaaccagatgtttttcccaccacaggacaaagatgagaacctccacgctgtgaggatagaggacaggcagggcaaagatgagaacctccacgctgtgaggatagaggacaggcagggcggtgtgaggacaaaaggggctgtggtcacgtccagggtgttctctcctagcaacgcctccagctctttcctcactctgtggtatttgtcagatgggaaacatacctcaaatttatatttgacatattgatggaagtccaggcaagaggcatctgaaagcttatttctgaacctgcttctgtaaggaatgcccatatcccttggtctctttcctctttcttaactccattggctcccttcccctcctgcacacacccactgacgtttatggccacttccccacacccttcactgtagtaccattttcttgggctcctgggaaacccaacagctttagttaaactcacagctatgtacacccataggcccctcaggaggttctcagtttcactcctacagtctcccaggctgctccttggggtcctaacctgaccatctctaccctctctcctgagtctggccatccattgaacgtccctgctgccctctaatctggatttgtgtacagtagaaggttaactcagcagacctggattgtttaaaccctgcacattcctgaaaaacattgttcatttatggctctcagttacctcctgatgagaactctgagcccttaaaatgctatgccagataacagtgtctgtggttgtctgcagccttgggacctgtagtacacatttaatcatagtgctttgtagtgaatgccagctatttttttttcctgggtagcgggggagctgttgtctgagtattgtggtcagttgaaatgcctaaccttgttttcactctaactcactactttgaatcttccctgtttgtctctttaatcacctagccttgcttctcatgtaagtaagactctctctagctgggaaagctggacaaactccaattgaccccttaatttacaagacactaagggctcctcacccaacccccttccgtaaggagttaacctgtgtaaacagattctcagcatttcaaaggagcccagttaactgataaggtactagcaccaacaatgtatgaagttcccaggatttttctcaaggagataacaacataaagccttgagttcatgcccggcatagcccctatatctaattataatgaaagatttagagccctgcacctggtactgttgctctttttgtaaccatttgtcttttaaattgtttatctctctgtaaccattttgcttcttttgattcttgcatgtttttacttccgtagaattattgcacttgagttcccctccccttcctaaacctaggtatgaaagttaatcaagccccttcctcggggcccagagaattttgagcattagccgtctctttggccgctggcttaataaaggactcttaattcgtctcaaagtgtggcgttttctctaactcgcctgggtacaacatttttggaggccgcagcgagatattaacaccactgggcgagagccggtctcgctccgggctcccccggaaggatggccagctcggaggagggacaccacctgaggaaagaattttcaggtccgcaaagagtgaccgccttccagaggagagcggatcgaccactgtgtcagcgccctaaaagtcaacatctgagtcctcagcttctgaccccggggtcaggtaggtcggatgtgacttcgtttccggtgagaggggagcggccctgacgagggcgctgagtcctcagcttctgaccccggggtcaggtaggtcggatgtgacttcgtttccggtgagaggggagcggccctgacgagggcgctgagtcctcagcttctgaccccggggtcaggtaggtcggatgtgacttcgtttccggtgagaggggagcggccctgacgagggcgctgagtcctcagcttctgaccccggggtcaggtaggtcggatgtgacttcgtttccggtgagaggggagcggccctgacgagggcgtccctcttttgactcagcccattactctaggatgctagtgggttgagccttcgttttccggtaggcgccttcgtatcttggtttgggtgggaagtggtcctgaccaggaccctcccttgacttagctcaagacccaggacgctggagagctaagccttggtttctggcagacctctctctctctcttctatcttccatccttcttttggaaatctccgggaaaggaaaaaaaaaaaaacctgttataaactctgtgtaaatggtgtgtgaatgtgggaggacaaaggcttgcgtttgtcttccagtttgtagctccatggcgaaagctacggagtttgagtgggccctcacctgccgttctgtggtgacctcataaggcttaaggcagcatcgggcatagctcgatccgagctgggggtttatactggcctgccaatgctaagaggaacccaagtcccctcacggggagtggccaggcaggcatctaaatgatcccatcacgggacccccttcccttgtctgtctaatagagaaggtaaaacaggaaaactgtcatcattgtttacatgccctagggtcaattgtttgttttatgtttattgttttgttcggtgtctattgtcttgtttaatagttgtcaaggtgttacatgtcaggacatcgatatagtccacgaggtctgggtaaaaatttcttcaaggtccttagtgctgattttttgtcacaagaggttaaatttctaatcaatcatttagactggccaccacagtcttgtcttttctgtcataaacaagtaagctgttgttacggaaaagagtgtggagaacattcacctgattggaatttctggcaccatgaaggttgcgggtatttagattgtcataccccacgtcctagtgattggtccccttctaaactgaactggtggtgggttcaaaacagccaccctgcagaccttcttgctcacctcttctgtcattctgtaacttttcctgcgcccttaaataggaccttgtgtaaagaaacctacgcccgtcatgctttacttcgtttagactcctattctgttccactgtggctactttctcatcttaaggacgatccgagtggtccttttccccctcgtccctgccccttaccccgcacatctcgttttccagtgcaacagcaagttcagcgtctccaagacttcgctctgctctcactccttgaacccttaaaggaaaaagctgaatttgaactgtttgcctttgaatcgtggagacataaaaaacacttaggatataggtctagaagaagaagaagagggagaacgcctagatcgaactggcccaggagacctcagactggccaccaatccccctccctcaatcttaaagctacagcaatgtggcaagtggtattagctgttgtggtttttctgttctttctgatcatgttaattctgtttttccgacactccagccccccagggaaagagtttctctgccggtgttggatctgatatctctgctcaagactttgctaaattgtctttaaataataataataataataaacgggaaacacctcctcctggccccgtaagggttggagccctctccagtgtatgctggaaaatttttctcttggtttctcagaggactatggagtccgccttagaaaaggcaaggtctggacactctgtgaactagaatgaccaaagtttggagtcggatggccctgtgaagggtcattaaatcctaccattgttcaagccgtgtgatgggttgttaccggaactcccggccaccctgatcagtttccctatatcgatcaatggctaagtttgattaggaatcctcctccatggctctgttcatgtgccattcgcaattccacctccaaagtcctcctgagccaggccgcgtttttgcctcaaccctccgccagttcggctccccctgttttgcctccctctgaagaagaggagagtcttcctcacccagttccaccgccttaccaccagcctgctcccttggcgccatcccgtgtctcttcgactgcgtcccctgtgggctgtgaccgcccattgccttccgctacgaccgcatgggaggaagcagcccctctactcccactgagagaggcacgagtcccgcggctgatgagcgctcagcccccttcctggtttatgtccctttttctacttctgacttgtataattggaaaacccataatcctcccttctctgaaaagcctcaggctttgacctcactgatggagtccgtgctccggacccatcgacccacctgggatgactgccaacagctccttttaactctgtttacctctgaggagagggagcatatccgaagagaggccagaaagcacttccttgcatcagccggtgggccggaggaggaagactagagacctcctggaggaggaggaagctagagacctcctggaggaggaggaggtctttccctccacctggcctaattggggcccagattcctcaggtggaaggagggctttggacgattttcaccagtatctcctcgcgggtattaaaggagccgcttggaagcccataaacttgtctgagacaactgaagttgtccgggggcctgatgagtcaccaggggtgtttttagaacctctccaggaggcttatcgaattcacacaccttttgacctggcgactcccgagaatagccgtgctcttaatttggcatttgtggctcaggcagccccagatattaggagaaaactccaaaaactggaaggatttactgggatgaatatcagtcagcttttagaaatagcccagaaggtttttgaaaaccgagaatttgaaaaacaaaaacaagcgacacaggcagctgaaaaagctgccgataaagcatataaaagacaagcaaaaatcttggtaacagctatccaagagggcagaaaggaaaggcctgcattccagaaaaatggccaaggaacctcgggttcccaccagaaaagtgaaagaggtgaacaggcccctctaggaaaacaccaatgtgcctattgcaaacagactgggcattggaaaaaggagtgcccgttactgccaaaagaaaaatctgaaaacaaaaaggttctcaccctggccgcaacagaggagcctgatgattgatggggacagggctcccttgctctcggcccccaggagcccatggtaactgctacagtggggggccagcctgtatgtttcctaggagacaccgggggagagcactccgcactggagactcccctggggagtgtctcaaataaaaaaattgctgtacaaggggtaactggagctatacaagaatatcctgtcacacacacctgagaagtaatcttgggacagaaaagagtgacacactctttcctagtagttccagagtgtcctattcctctccttggacgggacctactccataagttacaggcctcaatctccttttcagctcagcaggctcatctcacactaggaaatgcaacttcccccactgcccaactcttgctaactacccctctgtcagaagaataccttctggtttcaccgtcgtaatcaccggaggagaatactaatactcttttgttagatctacagacacttttcccccgagtttcggccgagtcaaaccctcccggactggctaaacaccatccgccagtagtcatagaactcttggccactgccataccggtccaggcaaagcaataccccacaagtcagcaggctagagaggggattaatccccacattcaacgactgttacaagctggcatacttaccccatgccagtcggcctggaacacgccatttttgccggtccagaaacctggaacaaatgattactggccagtacaagacttaagggacgttaataaatggactgttgctgtccacccaaccattcctaatccctatactctactcagcctgctcccaccagaacatacagtatacactgtccttgacctgaaagatgctttctttgctatccctctggcccccaaaatccagccgatttttgctttcaaatggacagatccaagatcaggagacactacccaactgacttggactcagttacctcagggttttaaaaattcccctaccctttttggagaggctcttcagcaagatcttataccttccgagccagtcaccttaactgtactcttctccaatatgtagatgacattttaataacaactgaaactatggatggttgtctacaacacacaagagacctgctctacctccttcaggagctcgggtatggagtctcagccaaaaaggcccagctttgtcttcccagagtgtcctacctggggtacaagataaacaaaggaaaaagggcactcactagtgcccggaaagaagccatcctgcgaatccccactcccgccaccaagagacaggtacatgaattcctaggagccctgggatattgtcgtctttggatatcggggtttgcagagattacaaagcctttgtatactgctacaaaaggtaatggcccactgatttggacagacaccgaggaacaggcttttcagaatctgaaaaaggctttaactgcagcccaggctttagccctcccaaatatctcaaagccttttcatctgtttgtccatgagagccagggagttgctaagagagtgcttactcagactttaggaacttggagaggcccagtggcttatttatctaagaaggtggatcctgtggcctcaggatggccaagttgtttggcagccatagtggctacagcaagcctagtccaagaaactgataaattaactctaggccagaatttaacccttacagttcctcatgctgtagagacttgactacgaagtgcttcaggtaaatggatgtcaaatgctcgtattttacaatatcagagtttactgttggatcagccttgtttgactttctctcccacaaggtgtttaaatcctgctactttactcccagatccagattctaatactcctgtccatgactgtcaggagctgttagaagctaccgaaactggcaggccagatcttcaagatgtgctcctgagaaaggcggacgccaccgtgttcaccgacggcagcagttttctcgaacaggggatacgcaaagctggtgcagctgttaccacagagacagatgtgttgtgggttcaggctttaccggcaagcacctcagcacaaaaagctgaattgattgcccttactcaagctctccgatgggttaaagataaacgtattaacatttatactgacagcaggtatgctttcgctactgtgcatgtacatggagccatctactaagaacgcgggttgctcaggtcagaaggaaaaataattaagaacaaagaggaaattttagccctgcttgaagctgtgtggctccctcaacaagtggctgtaatccattgtaaaggacatcaaaaagaaaacacggctgttgcccgcggtaacccaaaagcggtttcagcagctcgggaagtggcgctgtcttcagctccgtccataaacctgctaccggcagtttcttttccacagccagatctgcctgacaaccccgcgtactcaacagaagaagaaaaactggctgcaaaccttagagcaaataaaaatcaaaaaggttggtggattcttcctgactctagaatcttcgtacccccagctcttggagaaactttagtcagtcacctacattctaccacccatttggtgggacaaaattagctcagctcctccggagctgttttaagatccctcatctacaaagcctaacagatcaagcagttctctggtgcacagcctgcgcccaggtaaatgccaagcaaggtcctaaacccagcccaggtcaccgtctccgaagaaactcgccaggagaaaagtgggaaattgactttacagaggtaaagccacaccgggctgtgtacaagtaccttttagtatcagtagacaccttctccggatggactgaggcatttgctaccaagaacgagacagctaacacagtagttaagttcttactcaatgaaatcatcccctggtacgggttgcctgctgccatagggtctgataatggacctgccttcacctcgtccatagctcaatcagtcagtaaggcattaaacattcagtggaagctccattgtgcctatcaaccccagagctctggacaggtggaatgcatgaaccataccctaaaaaatactcttaccaaattaattctagacaccagtgaaaattgggtaaaactccttcctttagccctacttagagtaaggtgcaccccttatcaggctgggttctcaccttttgaaattatatatgggcgggcaccacctatcttgcctaagctaaaagatgcccattttgcagaaatatcacaagctaatttattacagtacctgcagtctctccaacaggtacaagagatcattctgccacttgtttgagaagcccatcccagtccagttcctgaccagatggggccctgccattcattccagctcagtgacctggtgtttgttaaaaagttccagagagagggcctaactcctgcttggaagggacctcacaccgtcatcctcacgacgccaacagctctgaaggtggacggaattcctgcttggattcatcactcccacatcaaaaaggccaacaaagcccaaacagaaacatgggtccccaagcctggatcaggacccttaaaactacacctaagtcgggtgaaactgttaaattaactctttttatttgcttcttttgtttatccttgcctgtaatgtcttctgtgccttcctactccttccccctcacctctctcacaacaggacgtgttttcgccaatactacttggaaggtggtactccagggcaagtcacctttgcagtcgacttgtgtatactgttcccggagccggctggtacccacgaagatcatcgcgacctgccagtcatgggagcaggaggtgtcgaccttgcagcaggatttggacactctgggagccaagccagatgtggaagctccaaaggtgctgaaaaaggactccaaaaggttgacttttacctctgtcctgaaaatcaccctgatgctagctgttgagatacctaccagttcgtccgcccggattgggcatgtgtaactttagccacttactctgggggatcaactagatctccaactctgtcaataagtcgtgcttctcgtcccaaatcgtgttctaaaaataattgtaaccctcttaacatcattgtccatgaacctaattcagctcaatggtactatggtatgtcatggggattaagactttatgtcccagggttcgatgttggaactatgttcaccatccaaaagaaaattttggtcccctggagcccacccaagccaatcggacctttaactgatctaggtgaccctatgttccaaaatcaccctgacaaagttaatttaactgtgcccccaccattctcagttcctaagacccagctacaaagacatcaactccaacccagtctgatgtctatacttggtggagtacatcattttcttaacctcagccagcctacactagcccaagattgttggctatgtttaaaagcaaaacccccatattatataggattaggagtagaagtcgcacttaaaggtagtcctttatcctgtcatgcacaacctcatgctttcacattaggagatgtgtctggaagtgcttcttgtctaattagtactggatatgacttatctatttctccttttcaggctatctgtaatcagtctctgcttactcccatgagcatctcagtctcttaccaagcacctaacaatacctggttggcctgcacctcaggtctcactcgctgccttaatggaactaaatcagaacccctcttgtgtgttctagttcatgtccttccccaggtatacgagtacagtggatcagaaggacaactcctcattgctcccccggaattacatcccaggctacgcagagctgccccactactggtttctcttttagccggtcttagcatagctgggtcagcagctattagtacagctgccctagttcgaggagaaactggactaatgtctttgtcccaacaggtagatgctgatttaaataatcttcagtctgccatagatatactacattcccaggtagagtctctagctgaagtagtacttcaaaactgccgaggcttagatctgctgttcctctctcaaggaggattatgcgcagctctaggagaaagctgttgcttttacgccaatcaatctggagtcataaaagatacactccaaaaagttcaaaaaaatctagataggagccaacaagaacgagaaaataacacagcctggtatcaaagcatgttcaattggaacccctggttaactactttaatcactggtttagctggacccatcatcatcatattattgagtttaatttttggcccttgtatattaaattggttccttgattttgtaaaacaacgtattgcgtctgtcaaacttatgtatctaagaactcaatataacccccttgttgtaactgaagaatcaacgacttgattcccctaaaacacaagtggggaaatgaaatgcctaacggtgtttttactttaactcgttactttgaattttgtcctgcttgtctctttaatcacctaaccttgcttctcatgtaaataagactctctctagctaggaaagccagacaaactccaattgaccccttagtttacaagacactaagggctcctcacccaaccccctttcgtgaggagttggcctgggtaaacagatcctcagcatttcaaaggagcccaattaactgataaggtacccacaccaacaatgtatgaagttcccaggaattttctccaagagataacaacatgaaaccttgagtttgtgtccggcatagaccctatatctaattataataaaagatttagaaccttgcacctggtaccgttgctcttcttgtaaccatttgtcttttaagttgtttatcactctgtaactattttgattattttgattcttgcatgtttttacttctgtaaaattattacatttgagtccctctccccttcctaaacctaggtataaaatttactcgagccccttcctcgtggccgagagaattttgagcatgagctgtctctttggcagccggcttaataaaggactcttaattcgtctcaaagtgtggcgttttcttaactcacctgggtacaacagtgcagctggtggagtctgggggaggcttggtagagcctggggggtccctgagactctcctgtgcagcctctggattcaccttcagtaacagtgacatgaactgggtccgccaggctccaggaaaggggctggagtgggtatcgggtgttagttggaatggcagtaggacgcactatgcagactctgtgaagggccgattcatcatctccagagacaattccaggaacttcctgtatcagcaaatgaacagcctgaggcccgaggacatggctgtgtattactgtgtgagaaacactgtgagaggacggaagtgtgagcccagacacaaacctcctgcaggaacgttgggggaaatcagctgcagggggcgctcaagacccactcatcagagtcaaccccagagcaggtgcacatggaggctggggtttgtttcctgtcaggatttgggacttcctctgcttctgacagtttctctagggaaactctttaattttagatttctgtgcccaccaatgtcatctctacatttttttaatcattgtaatatgataggaggacttattctcacatgcacaatatgtatattgccacctacgggaatgaaaactcctcaaccatggtcaccagcatcagagtcgtgaggaagctcaggggtgcctggtgagtcttctccagtcagactcaggacagtaacctcaaggggattcccttgtgagaactcacacactttcatgagaacagcaccaggagttggttctaaaccattcatgaaagacccactccatgacccagtcacctcccaccaggtcaccccttcacaattgaggattataatacaacatgagatttggggcaggacacaaatccaaaccatatcagatacacattgtgaaatgctcatgatggtcagggtaatttgtatttctatcacctcacagcgctaccattttattatttttttaaattaaatgcatgagtgagtgtctgatgagaacacctcagatataccctttcagcaacaatcatttttataatacagtattaactataggaccattgctgtacgttagatctccagaactcatccaacctgcacaactgaaactgtacaatttaacaaacatcacccgatttccctctcctcccaggtcctgagaccctctattctgctctctactttcaagagcttgaatattttagatcccacatgtaaatgagatcatgcagcatttgtctttctgcatctggcttattccactcagcatcatgtcctccaggcccatccgtgttgttgcaaatgtcagaatttccctcttttcaaagccaaataaaatacagatttatgtatacacattttctttatacattcatccatttacagtcattaaattattttgcaaatctacactattattaataatcttcaatgaacacgtctttggcaaagtaattttatttcctttgcatatataataagaaatgggatcaccagattatatgatagctttattttcaacttatcgagtaaccaatcctaccacagtgtattccctttccctcacattcttgccaatatttgtcatctattacatttctgataataaccatattaactagtgtgaggtgatatcgcattgtgcttttcatttgaattcctctgataattaggaatgttgagaaccttttcgttttctgtttgccatgcatgtatcttctgaaaaaagttatccaggtttttgcccttttttatcagttcatttgttatttgctattgaggtatatgggttatttatacatttagatagaccttcttgtcggatacataattacacatagtttttcctgtgctttgttgttaaattcaaagaaatcagttccgaattaatggcaggaattttttttgctccatgtgatttatgagtttatggcttcaggtattatgtccaatattagctgatttttttatatggagttagagaaggcctaattttatttcttttgaatatgaatgccagttttacaccattattgaaaagactgtcctttctctactgtgtgctcttggcacacaaaatcaggagagacataatgacaaaagaaaatatcagatgaatattcctgatgaacatagacctgaaagtcctcaacaaaatactatcaaatagaatccagaagcactttaaaatgtaatacatcatggtcaagtgggctttacccctgggatgcaaggctcgttcaatatccacagtaactgtgattcacaatgtaaacagaataaaagcaaaaaccatatgattatgtcaatagatactgagaaagcctctggtaggttctaacatccactcatgataaaaaccctcaacagactagacatcaaagaaacgtacctcagaataatagccatctacagcaaacccacagtcaacaccatactaaatgagccaattaaaacacttgtctttataaattacccagtctgaggagtttctttatagtgtgagaattgactaatacagcatccaaataggaaaggaagtcaatccgtccaccttcagcgatgatataattctatacctagaaaatcctaaaaagtctgccaaaataattctagaataaacaactttagtaaagtgtcaggatacaaaatcaatggacaaaaattaccagcatttctataagccaaccacatccaagctgagagtataatcaagaacaaaatcctatccaacttacagtatccacagagaaaatgaaatgcctgggaacacagataacaaacaaggtgaaagatcactacgaggagaactataaagcacagcagaaataaataataaatgatacaaataaatgggaaacatttcatgctcatggattggaagaatcaatattgtaaacattgtcataatgcccaaaggaattcacagattcaatgctatttacataaaactatcatcatcattcttcacagaatcagaaaaaaatctattctaaaatttatatggaaccaaaaaagaccctgaatagcagaagcaatcctaagcaaaaagaacaatgccagaggcatcatgatactgaccttaaactacaccataatgtcttgctaacaaaagcagcttggactggtacgatagcagacctgcagaaaaaaaaaaatagatcaaaattgaaaacagaaataaagttgcacacctgcaaccttttgatctttgacaaggctgacaaaagcaattggaaaaaaaaaatctctgtattcagtaaatggttctgggataactggattctggcaggtcttgcagaatgcaagagtgaaggagcctgtccagcttctacctagatttcagatgttagagagccctgcatgcccaggaagaagcctgctgcagcagtggatccaccacacaaagcctctactagagcattgccaaagatggggaaagatggagttggagcccccattcagagtccccactaggacgcttcatagtaaagctgtgggaatgtggccacaaccctcaagaccctagaatggtagagctacaggcaacttgcaccctcagcctagaaaagcttccagcacttgactctcacttgtgaaggcagccccgtggtctgtgcctagcaaacctatagggattggctgcctgaggttttggggacccaccccttgttccagtgtgccctggttgaagtacataaagtcaagagagattattttgtagtgttaggatttaatatctgcagtgctgggttttatatgtgtgtgaggcctgttggttgttccactggccaatttatccctttaggattggaattatttacccaatgcctgcaccatcattgcaccttggaagtaaacaactttcatttttaaacttgcaagctcacagctggagggacattgccttaagactcagatgagactttggacattttagttggaggttgatcaacttaacattttgggaactattgaaaaaaggtgattatattttgcagtgtaagaagaatatgagaactttgggtctgagagtgcaatgatatcatttaggggttttcccctccaaatgtcatggtgaaatgtgacccacaatgttggaggtggggccaactgggtggttttgggtcatgaggagatttttcaggactggcttggcatccaccccatggtaattagtgaattcttgctgtattagctactgtgagattttattgttcaaaaaagtctggcaaccctcctaccctctcatgtcccccctcctcaccatatgacacagcctcctccccctttgccttccaccatgactgtaagcttcctgaggccctcgcaagaagcagatgcttgtgccatgcttctcacacagcctgcagatctgtaagccaaataagcctcttgtctttgtaaatcacttggcctcaggtattaatctataccaatgtaaaatagactaatacactgcccaaagcaatatacagagtccatgcaatttatatcaagtaactaatataattgattacatatttttaaaaatcctaaaattcatatagaaccaaaaaagggtctgaaaagcaaaagcaatcttgagcaaaaagaacaaagctggaagtaccgcattccctgacttcaaattacacaacacaaagataacaagaaaggcagcgtggtaatggtagaaaaaaaatcaagagcccagacatacagccaaatatctacaaccaacggttctttgacaaaactgacaaaaatatacactggagaaacaaccctctattcaataagtagtgctgggagaattagatagccttatgcagaagaataaaatgagacttctgtatcatcatagacacaaattaactgtgaatatggattcaatgtttaaatttataaactcataaaaattcctgaagaaaatctaaaaaaaatcctctagacatttgcctaagcaaataaaatatgactaagactgacttcaaaagcaaatgcaatgaaaacaaaattagacaaacaggattaattgaaacacagattgtctgcatagcaaaagaaataaccaacatggtgaacagacaacctgtgaacagtaaaaaaaaatttgcaatctattcatcaaagggctaatacatagaatctacaaggaactcaaataagtcaacaagaaataacaaataacttcattaaagagtgagcaaaaaccagacatttctcaaaagaagacacagacgtggccaaaacaaataaaacatactcagcatcaccaatcatctgataaatgtaaattacaaacaacatgatatagcatcttccaccagtcacaatggctgttattacaaataaaaaacagcaggtgtttggagagaagcataggaaaaataatgctttttatatgcttggtgaaaatataaattagtacaacctctatgaaaaacaatacagaagtttctcaaagaactaatattagaattaccgtttgtcccagtaatccctcccagtgggtatattcctcccaaaaggaaatttttatatcagaaaaagtcacctgcattcctagtgtctttcacagcaacgtgaatagagttgtaggacattagcctaaataaaataactcaaaaagatcttctcttttataattggaaagtaaacaatgggtacacatgtacatacataaaaaacaaaagacactgggaactgcaaaagagggcaaggtgagaggaatgtgagggttaaaaaatcacctactggctccaatgttcactagtgggcgatagttacaccagaagcccaaacctcacctttatgaaatatattcatgttacaaaattgcacatgtacaccctgattctactgaaaaaaacagaaataaaacatgaacagaattgttagactgctagctagatttgtcaacaaagaaaaatgcaaaaggagcaattctctgttttggaaccctttctcattttctggtacaattagaaattgtagactaatccctatattctcttctgaagccctagcattagccatttctcaaagacatgctggttccttttttttttttttttttttttgagacagggtccagactcactgcaacttccacctcctgggttcaagcgattctcctgtctcagcctcccaagtagctgggattacaggcatgcgccactgtgcctggctaatttttgtatttttagtagagacagggtttcgctatgtgggccaggctggtccaaactcctgacctcaaaagatctgcccacctcagcctcctaaagtgctggaattacaggtgttagccactgcacctggtcactggtttcttttatagaagaatagtattaaaaactcaaatcttgattctgggtgtattttttattaatgtgcactcatttcttgtagaaattctcaggtaaaaaatctaggaagtatgtgttgtgtattaacccatatatacacagacatctaaactatttttatctaatatatgtacctatattatgctaaacttgcaaataaaatgacatgtccaccctaagttaataccacatggatgtttatcgcattccttctatgcctgacactaacctcccactccaaccacaaggaaccccatttccccatacgccgtccattctctttgtagtccaattccaagattcctgtggagtgtaacaagatgtgtaagttgtgctcttttgtggaacatcgtcaattggggtacaatgctgatgtgaagtttcttttttctttaatcttattgcctacaccatttctgaatctacttagtacctcttttgaattcatacatttgtaatggaattagacattttctatgttatctgcattccatcctggaattcctaatcacctatttttaaaaaaaattcttttgaagtaagattgtattagtcagggttccctagaggggcagaacaaacaggatatatatacgcacacaggatacacacacacacacacacacacacacacacacacacacacagagtttattaaggagtattaactcgtatgatcacaaggtcccacaataggccatttgcaagccgaggagcatggaagccagtccgagtcccaaagctgaagaacttggagtcccatgttcgagacaaggaagcatccagcacgggagaaagatgtaggctggaaggctaagccagtctaatcgtttcatgttcttctgttgttgttgtttttttttccctctggccacactggcagctaatgagattgtaccacccagattaagagtgtgtctccctttttgagcccactggctcaaaagttaatctcctttggcaacaccctcacagacccacccgggatcaatactttgcacccttcaatctaatcaagttgacactcagtatttagcattacaagtccaccccgtcaacttgaaaccatacacatctcctgagattatacataatcttcaaacaaagacaataataaagtcataattacacctaatataatacaactttattcgttcaactggaaatgcaccaatccccaatccaaatgctattacatatggtccactccctcaaggacacagccaggatcatcctatgacttggtgtctagaagactcatgcacttttaattttacctccaatattagactccactttatcacatgcagacactgcagaatattttaagacatcgatgtcttatgctgaaaaattcaacagtacataaaattgccttcccaccacagccagtggttactactgaataaggatctgccatcccctagggaggtgctatagtggatggtgtgcactgttagtagctatggaaattgatccattgtggcaaatggcagcatctttcttttataacattaaaccatattatattgtatacacataccacattgtctttattcatttgtctgtatgctgaccatcagatagtttccatatcttcgctgttattaacagtgtttcaataaacataggatgcagatatgtttacaaggtggtaatttcatctacttgggtatactcccagaaacaggatttctggtcatataatatctccagttttaattaatttaggacgctttatgttgctttccataattgtggaaatgtagaatggtatagccattatgaaaaacaattttggttttgagttatgatccataaacagcatttgcttatggctctcaatgagagtttctactaaatatgatggaaggccaggaaggattctcaccttaaagcttggatggattatgaatttacctcttatttcctaaaagcaaaagtttggaagcatacatgatggaggctgttggcaggtttcaggatgatctcataaaaggagaatctgctggataaaaatgttgggttttcagttatagacacacctacactcaatatgaaatgatgaagtcaactgaggatctagaacatgttcacttgaagcaacagcacattctcaaaggaacttattgctccatcacaagggcgatgaacttctgaaaccagtaaagtgtgagtgcacagtaagtgataacgttatcacgtttacatgaagtttgtttaatgtgccaaaggctggtacagattaatcttacacaaatatatgaaacatatttttccatacatagatatctagaggataatcctcttagcaaaacttcttcaggttacagaaatctgtgtaagttgtagatctcatggggaactgtctctttataaatactggtctgtttttcaagtcaggaaaaattatctctgttggagtaggcttccaattgtgtagacttctgaattgcttcttgagttgtaacaaatgaaccaaaaaatttgactaattggagttttgtggctgtcttaataaaaatttcttataagctttctttcaattatttgagaccagttttcctgattttatttttctccaatagataaattttcacaagatctcaggaaaccacctctctggctctttagtttaaaagactagcttcttaggaaaagaagcttctttctaacattgaagagctcatttattctgcaaaccatgaagtttgagtctcattgtcaagaatcatgaaaatttttactccaatatactgaaagtcatgactcttgaattcaatatttattggcattcacaaaagtgattcattctcagatgtgtcctatgttgctggcccaacatatcagtgaactgagtatcctcccttagctctctctgtctgtagcactgagtctacaatcttcagagtcatccatgaaggggagtcctgaggttcatgggattcttgtaaacattcaggtcaacagaagaaataagcaggattgagggctgccagccatttccacgccattaggaataattaccatctaagtataaaggtctacatcatacagaataccccacaggataggctgatgcaaaaaattccaaccccacagaggctccacagcaacccttacagttctttcagggaaggaataatctccaagttaaatgagtcagtaaagctgctctgagctacaggaaaaattggatttggccaggtttgtctgagttcaacgtgattattatactcagctcctgctccaatctggactgagtacggggaatttaaatgagcctggctgtgtggtttgttatatgaaaatctgaactatataaacataaatggcatgtctggactagcatgagggtgagagatcctgggaactccaccccccatactcttatcgccctttcctccaggaacctccaggttctcagggtgagaatccacatagatcccttcatggctctatttctaggaaaccaaatctctaataaatacacccagactttcttcagacacagaaaccatgggaaaggcatctctagatcctcatctatgtggggaaaggtaatccatccccattacaagcccatactagcaggcttcctttatcatgaaaatgggtaaaattagccaatagatgtaaatttaaagaaaatttcctgtgatgctccagccagaaaagagcaaaaatcagcttcacttctggagacttcccgtataggtcacagcccagagaaagaagatcaccacagcattaaaattcagctgtaagaacatgtaatgcttccgtgttccacacattatgtctcaccagtttagtcaatatggattaaatacgagagtgtggcaatgcacaaactctatctgaggaggaaataggagaaaaatgttaaggaaaatagaagaattcgacgcctctaataccaggaacttcagcacaaagaaaatgatttcacccttattggcctcaaatttatttttcctgtggcatctgcagggttccaaagtgagaaaaattaattcactgtgcatgcacttccgaagtgtccacttgcattctgatatctttacttctatttgcagaaagtagacacatattcagccttagtgccagtgtagggagtgctttccgtgacatggataccagaaaaatagggtaaacatagggcccattaatgtgaaaatcagacattgtgtgtgtgtgtttgtgtgtgtgtgcgtgtgagttgaatagtagagttggagtgggcttctatccacctacacctgcaggtattctcaggtgccataatcaactgcaggaccctaaaggaaataagagtccccccaaacccctgaagagtttttgggttcaccgtgtgtccaatgattcagtgcctcttgagctctaggaaagggctccccagtgatgcatgagatctttcttggggtctccctgcagagttcactgggattcctaaggccaattcagtatttcaaaagatggtgtgagaagcacaggctgtcactaaaggagaattctgagccagggcacagccactttatacttggctggggacactggtaggaatatactctgtgagatcagacaggaacctccttgcaggggcagggcagggctgcagggggcgctcaggacacacagagcacaggcttccgccccagagcaggtgaaggaggctggggaggggttcctctcagggcctgggacttcctttaaaaaatctaaaataagtatttcacaaggactgccgatgtttatataaatatcctattcaattgtgagcatttatgaaactcgatgttgtaatgagaaccacttttacaattggaatttcaaacttccctagacatcttaatagtaagcagctggaggtcaggaggagatcctttcttataaataagtgcaattttgggagaaacacactcattcccaaaatagcacattcacatattaaggtctagaaatgattcgagttgcccctgagacagtcaaatgtgggttctaagtgaggtgcgtgtcctgggggagcttgttctccagtgggggaagctctgtcaacacagagttcagggatgggtaggggatgcgtggcctctaacaggattacggcttgaaccctcagcttctacaattgtgtcgtccatgtgtcatgtatttgctctttctcatcctgggtcaggaattgggctattaaatagcatccttcatgaatatgcaaataactgaggtgaatatagatatctgtgtgccctgagagcatcacccaaaaaccacacccctccttgggagaatcccctagatcacagctcctcaccatggactggacctggagcatccttttcttggtggcagcagcaacaggtaacggactccccagtcccagggctgagagagaaaccaggccagtcatgtgagacttcacccactcctgtgtcctctccacaggtgcccactcccaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagacacagtgtgaaaacccacatcctgagggtttcagaaaccccagggaggaggcagctgcactgaatttgaggagattacagggcttacaatgtttaaagttgtttagaaaatgagctgagcaattgaggaatgtgagtaatggaaacatggatgcactctatataggaaatgtttctttcaacagtcaccctatatgcaaaattcagaatggtaaaggcagcaatcagtgaggctgacgcaaatattcccatggaggccttgtgcagacataccgtttttaaaatcagatagataaataatttggaacaagattgctggtaacgtggctaagactaaatatgattcctaaaaactggccaaaatctattccaaattgtctctgccactccttttacataaatgtattaaaaagtagttttaagaccacagcaaaattggacagaaggtgcagagagttctcatgtgcccctgcttcaccatgcacaggctttcccactgtcaccatcctgccccagagtcatcaataagttacaatggatgaacttacatgggcggattggttctttcctcttctggtggtctcttggcataccaagcccaaattatcttgaagcaccataggttctactgtaatgcctaaccttgttttttactctagtttgctactttaaattttccctttttttgtctccttaattgccagccatgtttcccatatgaatagactctccctggctgggaaagctgggcaaactccatttgaccttttgatttataagacattaagggctccttacccaaccctcttcttcaaggaattaacctgtgtaagcagatcctcagcatttcaaaggagcccaattaactgataaggtactggaacaaacaatgtatgaagttcccaggatttttctcaaagagataacaacataaagccttgagttcatgcccagcatagcatcatatctaactataatgaaggatttagagccctgcacctggtaacgttgctttttgtaaccatttgtcttttaaattgtttatctctctgtaaccatttgcttcttttgattcttgcatgtttttacttctgtagaattattgtatttgagttcccctccccttcctaaaccaagatataaaagttaatcaagccccttcctcggggccgagagaattttgagcgttagccatctcttcggcagccggcttaaataaaggactcttaatttgtctcaaagtgtggcgttttctctaactcgtttgggtataacactacaagtgggttcctgggaatgatgccagttcagaggaaaagtgggtggggctattcatatttgggctcttttttagaagattcataaaacagatattttcctatacgttctgtgactcctgatttactatcccttcccagagggtaaggtccctaagtgttttgcggtatatccatgtctatggaaagaaagcaagttctggtgaatcccgtaaggaatgtcctttgatgagaagtggagaccttggtcatgaggcacatcatgtatgattttctataattccgttagattcactgtaattttggggggtgtcctgtggaatgggtcttctgtgtccctgcatgttcagctatatctgtgtggtgccacttacacttaatgagatgagattcctgctgcttgtatcaggtcactggtgatctctgaagctgcttctggtttctgctttaatatgtaaagagcatgtcaaacatcacccacattcttacaataataaaagcctggaaaattgattatcaataatttcttgaatctgttgaagaaatgaaattgcagggaaaaccaggacccccaaaactagaaagacattaaaatagagataatcagactgatggatcaaagttctgtggcaataagataccaaattataaacaaggcctaaagtcatggattaagtcactcacccctacacttaaaaaaatgactgtactgtaacttccacagggcttttttgttttctgtagcacctaaacaagcactggttctgaggtaagcatattaaaacatttgcagctcatggaactccaaacgtggtaactgaccctctcccacaagccataaatagagctttgtttggacaagagacagatttcagtaactgtcttctgagaagagactactgaccatgaacttgtcctggcaatttacagagactgtgcagtgtgtgtctttctgcctctgcacaaagcccttttgatgaacagggcccgattgtcattcatttagttcttaagtcctcatccccaaagcaaacactaaatgcatgtaacatgtgtgtttgcttattagacatgagagcctgcccactatgtgaacatcaacaagatccttctatagcctgctgagtgtgtacacttggccaatccatttgcatgaattcatttctcctctttccctctcttgaagtgcctgctcactgtctctgtgggaggctttgcttcccagcctgttaaggtggctgtcctgcagctttaaccatttctcagaagtaaagtctcctttctaaatttataaattatgtgactgttccgttgaaagtgcaagctggtgggaacagttacatggtaattcggtaaattgctggtggacaggtgtggacagggatagggtaagaactcctgggggctgcacaccccacacttcgatggaatttccctccagaaacttctgggttctcaggatgataatccaaacagattccttcatggctctgtcatcaggagagctactctcttgataaatatgctcagaacttcctccagacaagatcctacagagaaaaaatgcttttcaagatcctctattctatgtgaggggaaggtattcttttccatcccaggcagtttcatcttagccttcctgtgtcataaaaaggtcaggttcaagacaataatatgtggatgctgcagccaggaggggggagtagaagacggaggaaaatcagctgcaccactggagactccttgtaaagggcacagtctagagaaaaaacatcaagaaaacattgaaatcaatttccagtacatatactgctcccctgcccaccacatcacctcttcaccagtatgatcaatctggattaaagagaaaagtgtggcaatgcacagactctgtccaaggactagaccttagggaaaccaaaggcagagggagaggaaaagttaaggacagtgaagcggtttaaagcctctgagaccaacagcttcaggaccaaggccacggcccctctgtcaatggccttagatttacctctcacggggcatccacagggttcccaggtgagaacaggcaaaaacaaggtgaagacactttccaaatctccagcagtactgagcttgctttagctctgtttgaagaaacaaaacaacaacaacaaacaacaacaaccgcaaatataaccaggattaaggtcagtgttggaagcacttttattaatttttttaaattttttatttctcagatggggtcttgctctgtctcccaggctggagtgcagtggtgcggtctcggctctgcaacctccacctcctggggtcaagcaatcctccaccctagcctcccaagtagctgggattacaggtgcatgccacggcgcccagttaatttttgtattttttagtagagacagtgtttttccatgttggtcaggctggtctcgaactcctgacctcaggtgatccgcccaaattgccctcccagagtcctgggattacaagttaattgagttaataaagctgttctgaactatgaaaaacattagtttgctcccagattttcttgatttcagtttgattattatattcagctgctgccctaatatgtttgagcatgttactatttaaatgaccctggctgtttgatttgttatatataaatctaaactaaaacaacttaaaggacaggtttgtactattattaggatgagatattctgggtgcccctcatttgctccatgaacctccacatttttaatttagaattcacataaattccttgtgagttgtgtcagtcatcgagagacctaatctctaacacctttacccagaaccttctccagatagaccacccacaggaagaacatttatagtaatttatctacatggtggaaggtacttcactgccattgtagaaccctcttcccagccttcctttatgaggcaaatgattgccagtatggtaagattgaacaaaaggatgtgccagtagggtaagattgagcaaaaatagtcctgagatcctgcagacagggaaggacgtaatagacaaatatcagctttattagaggagactccttgtaaaggtcatagccaagaaaaagaagacaaaatcactgagattaaattctaagaatcttggtccagttcaatcaagccatcaacagccaggtggcttcagtggccactatgcatattaccccatgcctaaatgttctggcttgtacaaagagcttctctgtaaattgcacattgccatagtggaagatggcatgggagattttgtgacaaacacttaaggtgcaataatagctatttttcctttatcatgacaatatgtggcatgcttctagattcatttcatgccaaagaagttcctcagaagggtaaggaaatggagaatcttacacggtccaatgcagtccccaagaagggactttgaatggacagttacactggttactacgatgtgtctctgaccttctcaggatcgaagatagtcatgagtatcaaggtggagatggtctaggtgagagaaaggaagtagtgttcttagaagatggtatgccaagataagcctgactatctctcctcttccagttcctgcaacttcatattgcctgattgagtcacttgcctatggtggtaatgacatcagcaatgcaataaattctctggtggctttatatctggtttataacatgggagatgtttcctcaagagtggtgatgccagtgtggcttctgctctctggtggtgttggaatctgcattagtctgtgggtttggaggaaggagattcagccatggggaagaatctgacactctcacaccctctgtgccttcggtactggactgctcctgccctcactatggtgattgcatcagatattgcctccccaccagacaacacgttaacatggctccttgtacctggctttaaccaagaaagttgtcgacttgactcttcgtgacattgtatagcctggtttgtcacaatctttatttcgggaattatcagtgctgccatcttggctgtcttcaagtatgtcatcctcacagtgtgaagctgtttgacattaacatttttgtcaatgtttgggactaccttacatattccggctcagttcaaaatgagctatgtaatgtagccaggtttccactgagttccactttgcttcttggctgtctattcctgcgcaagtttctatgtattttgtatcaggcttcaattccattatgtttaaaatgttgtctctaaagataaacaaagatttttttaaaacaaccaaacatgcagccatttgaccgagtgtggtctgcattgttagtctcaccatcttctgccctaacaagcaccgaatctaacaacacaaatatcatggaagctttccttggagtagctcctgtaattagaatcattgtattctgccctcctgtcagtggtggaacgttctattggcacatgtggaaacctcttagagggacgagtttctttgaacacaataaaattttaagttaggaataacttatttgaaagcaattcattgaaggttattgctaagaagttagaaacagtcttttggcagtcatttcttcaagatgtatggcagtgtgggagggatatataaagtggaataggaacttgggctagttaaatggaatagcctccaatgttaatctgtttaccttttaactgaatgaaaaagcctatagttgtaagaaaagaaaaaaaacacaatcctcacacattcccttcccatcagcattgaagatgagtgtggcaatgcagagactctatatagggaggagaacatagggaaatgcaaagacaatgggagaaaaaagtcaaggacagtagagcaactggaagcttctgacaccaacagcttgatgaacagggtcactcaacccttggtggacacagagtcacttctcttagggaaactgcagtattctcaggtgacaatatgcaaacatgatgaatgtacacttgctacgtctccagttgtgtactgttttccttacttctgtttggagaaggaagtcatatactcaggtctagtatccgtgtagagggtgctcaccatttgcaagatactaggaaaaatggcaagttagaggcccactgttgtaaaaatcaaccagttctgtgtgtgtgtgtgtgtgtgtgtgtgtgtgtgtgtgttatagaaaaagaagacatggagtgggcattgatccacaagtatatatacctacaggtattcttagatgtaatattcaattgcaggagaccaaacaagataaagcatcccccaaaacccttgaaaatttttgtgctcactatgtgtccactgattaaatgtatcctgagctccagggaagggctccccgatggtttcttagagttcactgggtctcctaaggtcaatgttttcaaaagatggtgtcagtaacatatggtgtcactgaaggagcattttaaactagggcatgacctcttcctatagccctagagacactgagagagaaatcctctgtgagcccagatggaaacctccatgcagggcagaggcagtgctgcagggggcgcccaggacccacccagaacaggctccagccccagagctggtgcacaggaggctgcagaggggatttctcccagaattgagtgttgttttattgaaaaccaaaaaattataacatgttaaaattagaattttgcaaagactatttctattatctctatacatttagaaataaacaaatcaacaattcagtgagaaccacatttaaaaggcaaaattgttacttgtttgagatattttcctagtaaaaagatgaagaacagggatggttttattaaatcaaaaggtacacatttcagaagacgcagagatcccaagagtaagactgcagacagcaaagcctagaaagggcggaggctgtccatgtgccatgtcctgtgtgagtcaccttcttagtggagaagttctcccttcacaaagttttgggcatataaagggaaacacgacattaaataagaacgaggacttgtacctcagcatcccacagttgtgtggttcatgtgagatctattttctctttctcatgctggatcaagggtaaggctatgaagtagtagttctcgtgaatatgcaaatcacctgaggtgaacactacagatatgtctgtgccctgagagcatcacccaataaccacacaccacaaagacactcgctgagaagagcaaccctaagacacataattgtcagattcaccaaggttgaaatgaaggaaaaagttttaagggcaaccagagttgtgccatggcacagtgttgtgccatgtcctttctctgttttcttgcctgtttatttatgtcagatgtgccacctacatggaataaggtcagaattctgcctccagtaacacatcaaaggtgacctttgattgtacttttggtttatgctccaaaatattgattataaaattcatcaccgtcatattttatgtcaaaataaatctgcataatctgaatgtcagtacattttggaatctattaaataactgaaattgcaagaaatattacccactccaaaaactggagagatgggcatgtccagaatggcagttagcacttgcttacctggtgcagaaactgcagaagccacaagctgttgagggcacttacatggtaaccactacggacgtctgaaagacaaatgtggactcggtaaatgtgaccgttccagagggtcttatacttctaaggtttctggactttctctccagaaacctccagattctaaaatatacaatccaaataaatttccgatgggtcagaattgaagatgaaatgaagatgattaattacagagaaatataccaggagcccacttcaaaagcttctaaagggaatgacttttccagaaccttatcctatgtgaaggaagacaaatctcccattccagattctcccccattcttccattattatatgaatgagtaaagttagccaaaaggggtaagacgtacataaatagtccaaggaggccgaaacctcaaaagggagtaacagccaaaaatgagcttttcccctggagatgctttgtcaaggtcacagcccagaagaggaagcctattgaatctctaggtttccattggaagaacaggcagtgcttacctgcactgcacaatccattctaactaggatgatggctatggattaaagatgaaagtgtggcaatgcacagactccatctgaggagaacacagaaatactaagacaatggcagagggtgagacaaagacagtagagcaatgtgaagcctctgacatcgtgatttttaagaccaacatcttgtaaatgccatcatagttctcagcttcttttattatgggacctttgctggtttcctagctgagaaagtgaaaataacaacctgcatggacttcccaagtctccacctgtatcctgtttgctttagatctctaggagaagaaagtcagataactgggcctggtgtcagtgtaggaggcacttcctaaaagccacatattaggagaagggaaaatgtgtgttattggaatagtggatatggagtgggctttcatttgaatgtatctgcacctgctagtattctcagatgcaacattcaactgcaagagcccagtgaagaaacatggcactcgcaaatctcttgtaagtttttgtcttcattttggttccactaatgaagtgaatctggagcttcagggaaggggctccctcctgtgtcattgaatccttgctctgggtctccctgcagagttcaataggtttagtaaggctaatcaattgtttcaagagatggtgtcagcagcatatggtgtcactgaaggagtattctacactagcacacagccatttcatgctgggctagagaagcctgggggaaatgatttgaagtctcagcaaggaacctccttgcaaggcaggggctgggctgtcgggggcaccgagcaggtgagtcagaaatcaatatgtaaagatgaggacctatggatatgaattgaaaatatataaatacttcaaaaaattccagtaaattgagtccaaaattaaccccaaattattcaaaacacaaattccttgacaattattttgggagcagtgagttcataaagaattcaaaactactgtttcagcttctgattcttattgttcctgagatgagaaaatcatctctaatcacacatcacacagcaaatctgtaaacaagagtgtttctatggaagatcctgggggatctgaacaccaggcaggtgctggagaccctgtttcaggagcgcccagcagatctcagagggacctgctggtcactcacgtgggacatcagcagtaactttctcagtcaccagtcagctgtgctggtgactgatggacccaggacagaaccaaggcacctcctcagtgtcatggagagtgatggttccagaaatcatccaggtgctctctgtgcttataaaatgtaggttcactgtgaggagcatgttctgagggggattgttctgtgaaaggacctctgttcatgagtgttcataaatggagcagggcatgcatttcctcaaacaggaatagcgcttggaccatcagcatctcactcttgtaaatctgatgtgtcatttatcttccctttcttattattgaccaggctttgcgctatgaaatgctctgtctcatgaatatgcaaataacctgagatccactgaggtaaatttggatgtctgtgccctgagagcatcacccaacaaccacatccctcctctatagaagcccctgagagcacagctcctcaccatggactgtacctgggggatcctcttcttggtggcagctgccacaggtaaggggctcccaagtcctagtgatgaggaggggattgagtccagtcaagggggcttttatcatctcctcccttctcctcacagatgtccattcccaggttcagctgttgcagcctggggctgaggtgaagaagcctgcgtcctcagtgaaggtctcctgccaggcttccagatacaccttcaccaaatactttacacagtgggtgcgacagggccctggacaagggcatagtggttgggatgcatcaacccttacaatgataacacacactacgcacagaagttccggggcagagtcaccattaccagtgacaggtccgtgagcacagcctacatggagctgagcagcctgagatctgaagacatggtcgtgtattcctgtgtgagagacacagtgcgaaaacccacatcctgagagtgtcagaaaccccaggaaggaggcacctgtgctgacacagaggagatgacaaagattattagattaaagattttcttagaaaatgacactaagtcattaaagaaaaggaacaatattaatgtgtatttgagaaattttaattatttgagagatttttcatacagcatttattctgtaaacaaatttcaatgattacagaatgaatcaaattaatgaaactaatacagaacttcctctgaaggtatctttgtaaacattaatttcttaatcagtgctgtaagtattttggaacacagacacaaaatcacattttaagtctgcatttatgtctattaaaaatgccaaaaaaatctccttttgtgcatgtagcattttgaattcccaccatcaatgcatgatagttcttggttttccacattcatattgtcatgtatccttatgagaattgtgtgttttaaccaatctagtaggtgagtaatgggatctaatttttatttaaatgcacatgtccctccaaaagttcatatttaacaattttcctataacttctgttgagacgcctctcctgacattcggttcattttaactgcattgcttcatttcgattcattgcaagttgacttgcatattgtttataaaagtcatttcacaaattaaaagaattcatttcacaaatatgtgacttggaagtattttctccaagtctgtggctgtctttattcccttatcagtgtgtattgcagaaacatatgtgtgtgtatgtgtctgtgtgtgtatgtgtctgtttgtacgaatttagactcaaaaacatgtaaaattgcattcattcatagatgatgtatttggcaatatatatgaagtctcattataaaatacactaatagtgattattttttccatgtctctcaactcaggccacaatcaactcatgagtgtttaaacttcatctacttgattggaggactatccatttcagatatttggaatacttctgtaaggaaatgtgttcatcttcccaatatttatttatataatcatctattaatatgtgtattggtttatgaatatatatttcatactctgaagaagatccatgctatattattcattttatcgttcaaatcaccacagctttattaggtcctgggagctcatttaatttggatcctgtatccttacagcacacctcatccttttgtttttgaatacttccctgtttccttgtattacaataaattctaagctcattttctatattaccttttttgtacatagaattagccttttttctaaagattgcttgtttctaatgttaacgaatagcagtaaaataaaaaaaattgtgataccgtgtataattacttctaggacctctcaacctactggcctagtagacgtgcatgtttatatgaacccatgtttgtggacgcatcaaaactatttatgtaactaatcttctgtaactttattatattaaaaatgagaacacactggtctcctgacccaactatgctaccacatggacctttctagccttccttccttgactgtccataaccacccactgcaaagtgaggaatcctatcctaccaactgccttattattacctagttgcacaattttaggacacatgcatagcggtatcagaaatgtaaagctcattggaaatatatttatctactagaatagagtgttatgtgtagtttctttacattttaaacttatagaatttcctcatttccaaagttaattagattagcaacttcattttctactttctttagtgaagtcatttcaattacattatataatatcatttatttgaaattcggtataaaccaaaactatagtcaagtaaacagatagaggatattcaaggaacttagagagtgagtattaaataagtacaaatggcactgtttaagaatagtaaaattatttttagtgatataaaatggttgagacacgatgcagttaatttgtctaaactcataaatgtgtgatggaaaatataaacctaaatatatacaatttttgtaaaaagtatttagcagttcattaaccccaggattaaatgcagactgtatcaagttatctaataacttatttggtgagggtggggatgtcatgagatgcatgcaaaaaagaatgaagtaattttcctcatttgcgtttaagatgttaccattcactaaagacctttaatttaaaaaaaatcaattttctacgtgacccaggttttttcttcctgacgagcaaataacccagataattcttttctttccttggttgagaaagattttccccaaacttcagctcagttcaggcacacactgtccctgaatgggcatttaccctcagatgggtaacacacctgtcaacatggggactcttctgtcagacaaacacacctttactcacgtggattcttccctcagaccaacacacaagtccccacatggactctttcctcagaccaccacatatgtccttacatttactctttcctctagtaatgacatttcctcatgtggactcttgtctcagacaaacaaacatgtctgcatgtgaactcttcactctgataagtacaaatatttccacagtgactgtttcctgacacaagcacatatatccaatgttgaactgttttatggcaaaatgatctcaagataataattataaaatccctcctgacaaggtgtagatctgcatttttttattgtaccttaactttgccttattgtcaagaacaatagtttgcagctctatatgcaccgattagagattggtgtccattttctctggaaatgtatttttatattcttactggatgtatttttttgataatgtttgctactgtgaagatacctgaacagggtccacactagaaaataaaaaagactaatcggcagattaaccctgtgcatccagacccacgagtcctttgatcctgcccccctgaaatggagacacagaggacagatgagcaatgctgagcggtgcacccaagaccacaaaaagaaagacaaggaaatgtgtcccctcccctcctcatgaaaggcagctcatcccctgttccttcaggccctggtgaggagccaacccatgtctgttcccttcctcggtgtccacaccgtggggtctgccctgatttgggcttcccttctcatcaccctcaatattagtgtcccttgtgaatcaggtccagctgcggctgctccacatggggccgttcttccatttcctctgtgtttgcagaagtcctgtgtgaaatttactgatagagtcaggggggaaaattgtacagcccagtggttcactgagactctcatgcaaagcctctgatttcacctttactggctacagcatgagcttggtccagcaggcttcatgacagggattggtgtgggtggaaacagtgagtgatcaagtgggagttctcagagttactctccatgagtacaaataaattaacagtcccaagcgacaccttttcatgtgcagtctaccttaaagggaccaaactgaaagtcaaggacaaggccttgtaatactgtgagagacacaggagagggaatatctgcgtgagcccagacagaaaaatctctgcaggaagacaggagggagctgcatggtagatgctcctcagaaccaccagggcaccttggggacaacctgggggcactcagaaccaccagggtgtgcttaggaccacgggacactcaggatattagggggtgctcaggatcacgagggggcgctcatgacaccaggggacactcagaatcacaagggggcgctcaggacacgagggtttgcccgggaccaccagcaggcactcaggtcaccagggggtgctcaggaccaccagggggcgctcaggacaccagggggcgctcagaaccaccagggggcgctcaggacacctgggggcgctcagaagcatcaggggtgctcaggatatcagagtgccctcagtaccacgagggggcgctcatgacaccaggggcactcagaaccaccagggggcgctcagtacacgggggttctcttaggaggcagctccaaatcagaagcctgagaggctgtggttttcttttaaaccttggtgattcccgacctggtcaagcaaaagtcttccccaggatctctcaccatttcttccttgtaagtccatgattacttttacctacaaaacattaacttagaacaggaatttaattcaacttttaatgctgcatattttccaagtaatactagcaatgatctctcaggacaatttttacaataggttatttatatattttcttgattaaaaataatactattattaaaatagtaaagttataaaaatcacacctgtaatcccagcactttgggaggctaaggcaggcagatcacttgagctcaggacttttagaacagcctggcagcacagtgaggtcttttctatatatatatatgtaaaataataataataataataaatacctgggtatggttccacctgtggtagcagctacttgaaaggctgaggcaggaggatcccttaagcctgggaggttaatgctgcagtgagctgtgattgtgccactgcactccagcctcgttgacagagtgagaccctatttaaagaaaatgtataccctcaatacaaactgtttcaatgattagagttttgtatttttgtgctgtaatagtcaaacaattgtacatgttttttaacattaactcagcatatacatggtattttgtttatttttctttcatctgctgtttttggaaattaaacacgactttaaatgctcttgttctccattttggttggcttcaggtgtcctgtttttcagactatttctccatcttccctttctctttgaaagtattttactttcctcagtctccatgaaggaaaaagaaagtccctttactttctgacctccaagtctgttgaatcagttcccttctcttcataatcactgaagccaaccaagtttagaggataatggttctccttagaatatgctcgtctacctgcagactctctgccctaactcacccttttccagggtcctgcagaccatctcctcgtttccctaagtaccacagagtgggctctgcagctcctgctgccctctgtgtgctcagccctggggctcactagtgttttgatgatcaagtccaaatccccatgtgcttggaccctctgagaccaccctctaggaagatgccattgtgagtgagccctgaaaatcatggactgtgttcagtttcatattcctggatgttctctgttgtaaaggaatattgacaaataaatactagagtttgtattgaatattcatgccaaaaaagttttttaaaaatttttcaaatgaaacaattttatcttgcctagtttgaaaactacaatctaaatttaacaaataatgtaatacaacgtttgtcctattagttattcaatttattaaaaacagactgatatttaaagttaataccattgcacatttgagtgacatatttggcaagaacagcatttacattcagctttaacaaaacatgtatttatatatatttgtctttttagtattggaataggcagacatacacgtagaagagcattattttctactacaacctcaaactgcaaacacaatttaaattcaattaagtaataaaaaaaatatgaaacaaatgggtgtgctgttttggtgtttagatatacattcacttttgcatgggcacatgtatgtgtctttgctgggctgttgtgtatgtatgtgtgtttgtagaaccatgaagttttcaaatacatcattaaatgacatagttatattaatcttggccaggcatggtggctcaagcctgtaatcccagcactttgggaatcttaggcaggcagatcacctggggtcaagggtttgagaccagcctggtcaacagggtaaaaccccgtctctactaaaaatacaaaaattagccaggtattgtggcacaagcctttagtcccagtgtggcagggaaatgtggggtcggaaatcccacacagagtttctactggtataccacctagtggagctgtaagaagaaagccactgccctccagaacccagaatggtagatccactgacagcttgcaccatgtttctggaaaaaccacataccctcaatgccagctcgtgaaagcagccaggagggagactgtgccctgcaaaagttttttaaaacttttcatttgaaaagttttaaaaaagttctgtcacaggggcagaacttcccaagaccatgtgaacccacttgttacatcaggtaacctggatttgagacatggagtcaaagaagattattttggaacattaagatttgacttcccagctggatttcagacttgcatgggacctgtagtttggaccaatttctccatttggaatggctgtatttacacaatgcctgaactcccattctttctaggaagtaactgacttggtttttattttacaggctcatagatggaagagacttgcctcatctcaaatgagaccttggactgtggacttttgagttaaggctcaaatgagttaagactttggcagactcttgaacaggcatgattggttttgaaatgcgacagcaatcattactctagaggaccacacgtgaagtgcaacaagcaggcgcagaagacaagtgattcgtgatttcactgtagtttgtttaaatggtagactcacagaagtagaatagaatgttggttaccaggggctggaggggtggactggaaaaggagagattgtggtcaaagtgtaaaatgttccagttagacagaaggagtaagttacagtgttctaatgcacaagatggaaaatatggctgtgaatgcattatatatttcaaaatggctaaacatgcaaatgttaaaattttttcccactaagaaattatacaggtcgggagcgggggctcacacttgtaaacccagcactttcggaggccgaggtgggtggatcacaaggtcaggagttcaagaccagacttgccaagatggtgaaaccctgtctccactaaaaacacaaaaattagccaggcgtggtgttcaccacaggagaattgcttgaagcaaaggctgcagtgagccaagatcataccactgcactccaaccggggtgacagagtgagactcagtctcaaaaaaaaaaaagaaatacatttatgaggtgctggatatgttaaatagcttgattaacaattccataatgtatgcatgtatgatagcatgtgtgaatggacctgtatgaaggtgaggtgccctggtcacgtgacagtgaggtgacttgggggaggtgtaaggttacctgggggtatgtgtgcggtgaacttgggcacatgtgaggtgacccacggtgcatgtgtggtggcctgggtgcgtgtgaggttacctggacatgtatgaggtgacatggggaattcgtgaggtgacttggatatgtatgatgtgacctcaggcatgtgtgaggtgacctggccgacgtgtgaggtgacctgggggacgtgtgaggtgacatggggaatgtgtgaggtgacctgcgggaatgtgtgaggtgacctgcgagcattccaggtgacctggggggtgtgtgagcttagcaggagtgtgtgtgaggtgacatggggtatatgtgaggtgacccccctgacgtgtgaggtgacctgagcacatgtgaggtcacctaaggcacatctgagttgacctgggggatgtgtgaggtgacctagggaaatgtatgagctgacaaagggcatgtgtgcagtgacctgggtgcatgtgaggtgacctggtgcatgtgttagtttacctgggggatgtgtgaggtgaacaggggcaggtgtgaagtgcctgaggaatgcatgaggtgacctggtgcatgtgtgtggtgacctagcagatttacgaggtgacctgcgggatgtgtgaggtgaatagggacttgtgtgaggtggccacaggaatgtgtgaggtgacctgggggatgtgtaaggtgacattggggatgtgtgaggtgactcagggcacatgtgaggtgacctgggggatgtgcaaggtcaccttgggtgagtgtgaggtgaccttggggatgtgcaaggtcacactgtgtgagtgtgaggtcatctgggatatttcaaacttcgtaaggaaagcctgcaacagtatatggcactaaaagcttcacactccaacaccgttaatgcgcacatcctcaaggaactctaagtgtttccaggttagcttaaatgccatggagcgacacctgccccaggcacactcatatatgcatcctgggtctccctatcaacccctatcctcaaattttcagtttatgtttgctccatgatatcaactctgatatgttgaaggttttttttttcttttatttgtagttgttcaggtttgctatttcactctcattactctgggctcagtcctctcctcaggtgtcccacttcagagcttgctatataataggagacatgcaaataggaccctcccttttctgatgaaaagcagcgcagcctgaccctgcagccctgggagagaagccccagccctgggattctcaggtgtttctattgggtcaacagcaataaacaaattaccatggaatttgggctgagctgggtttttcttgctggtattttaaaaggtgattcatggagaactaaggatattgagtgagtggacatgagtgagagaaacagtggatatgtgtggcagtttctgaccagggtgtctctgtgtttgcaggtgtccagtgtgaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaatcctgtgaggggacacaagtgcgagcccagacacaaacctcctgcaggaacactgggcgaaatcagctgcagggggtgctcagggcccactcatcagagtcaaccccagagcaggtgcacatggaggctggggtttgtttcctgtcaggatttgggacttcctctgcttctgacagtttccctagggaaactctttaattttagatttctgtgcccaccaatgtcatctctacatatatttttttaaatcattataatacgaggactcattctcacatgcacaatatgtatattgccacctacgggaatgaaaactcctcaaccatggtcaccagcatcagagttgtgaggaagctcaggggtgcctggtgagtcttctccagtcagactcaggacagtaacctcaatgggattccctgactagaatggcttttagggatttcgattacagccaagagagaggctggaccaggttcagtgtcatgtaggacctcacagattttatgtatgacatttctcctgacaataaagtatgcaaatgagtatcagtcactgatctggtgcttcctgactttcatttttagtggttctcgcttttccatttgattttcctgctttctggataaaaggatgttgtccctgtggtctaaatccctggggctcaagccctttccctggagcttaggtggggctcaggctgtgactcctgcagccattgggagaggctgctgagactttcttctctctcattgttcaggatactccactctgttttctggagacgcgtctgagaacgcgtgtggccattagtaatgagggcacaagcttctttggtcaaaatggggtgaggatgtggaattgatcctgtgctgtgtaaactgtcacagagtcaccttcttcaccagtagtgttagaagagcttgtaaaatttgtcggaatccaactggagtcccctgtgttcaaaccctgacaaatggagctggggaaggccatggatggaagcttctcatgcacatacccctgagaacaagacctagctttataacactccaaaaaaccacaaattgaacaaaggcaaccacaacaataaaagaattacttatatccctgagaacaagagctagctttataacactcagaataaccacaacaacaaaataattacttatatacctaacaacaagagctagctttttaacactcggaaaggccacaatcttgcacaaggcaaccacaacaatgaaagaattacttctgtgaaaatatctgcacagcaactgcctatccaaccttacactgatgtcaaccttgttattgatgcttctagcccaggatcgtcctcatcaaaatgtcattcagatcctgcctatgaaaaaaattgtgtttttcagtgcactcatgttctagtaaagccctcagagaccctctccttcacctgtgctgtctctggatttccaatcataaccagtacttcctcctggagctgtatctgccagcccccagggaagaagctgaagtgggtcaggtgtgtaggtcacgaggaaacacacagtgcaacccgcttctcaagagtccagtcaccacctccagatccacattcagaaaacagtttttcctacagctgagctacccgcacaatgagtaaaccaccatggatttttatacaaaagacacagaaggggaggtcattgtgaggccagacacaaacctccctgcagggaagctcaggacaccagggggtgctcagacaccaagggctctcaggacacatcaaggcaggtgcaagaggggaaaaaaggtgctggaggtggggtttttcatcactgtcatattttactctccactatatttattctaatgtatattattttattattagacaatgatatttatataaatatatagccatacgtaggtgcaccaagttgtcctttccatcttatgtggaccttgtccattaggacgaagtccctgtatgtatttgagcacctcataagttatggttaattatgtaggatctctcactttttctgtgtcccttcctccctcctctctcacacacaaactgacacccacaaagagttctacaactttaattacctgatgcgttgaagaaaatttactgaagtgcagctttttcagtttaactgctgttcatgttgatgtaggaataagaacattgtctttctcaactgtgtagctctctaagctgagtagcacctttatttataatacccagatactgaaagcaatccaaatattgatcagcaggttaagcagtaaacactttgttctaaattcgttcacttgaataatacccactgttcaaacaagtacggctggaaatgctcaacaagggtaaattcacaagtacttatgaagagtaacataagccaaagaaatacaagtacatacatacagttccacttttataaattttataaaatgaaaactaatctaaagttacataatgaaaaccagtagttggccgtggacatggtatgagaagggaaggtgtaggaagtggcaattacaggacaacgagaggaaattttgaggataattttttctgtattgagaaaggttatggttatgtcattatttgtcaaattgtacacattaagtgaagattattactttctaatttcgacttcttaaaatactacaaatttaaacatatataatttggtagaaaaggagttagagatggataaaatatatgagaaataaaaaagaaaatctcagaacgatggcataaggattcaaccatcaaactaaataaattttaaatttctcaacacagaattatagattcataaaaccagctcctggattcattgattttgtggaattgatttacatgtctttatctccttcagttctgctctgatgttaggtatttcttctcttctgctagcttgtgaatttgctcttgcttctttagttcttcaaattgtgatgttagggtgtcagttttagatctttcctgctttctcttgtagacacctagtactataaatttccctctacacactgctttaaatgtgtcctgaagattctcatatgttgtgtctttgttctcattggtttcaaagatcatctttatttctgccttcatttctttatttacccagtagacattcaggaacaggttttccagtttccatgtagttgtgcagttttgagtgaatttcttcatcctgagttctaatttgattattgcacttgtggtctgacagactgtttgttatgatttctgttcttttgcatttggcgaggagtgtattacttccaattatgtggtcagttttagaatatgtgcgatgaggtgctgagaagaatgtatattctgttgacttggggtggagagttctgtagatatctattaggtctgcttcaagtcctgaatatccttgttaattttctgtctcgttgatctgtctaatattgacagcggggtgttaaagtctcccactcttgttgtgtgggagtctaagtctctttgtaggtctctaaggacttcctttatgaatcggggtgctcctgtatttggtgcatatatatttaagatatttagctcttcttgttgcattgatccctttaccattatgcaatgcctttctttgtctcttttgatcttttttggtttaaaatgttttatcagagattaggattgcaactcctgctttttttttttttttgctttccatttgcttagcaaatattcctccatccctttattttgagcctatgtgtgtctttgcatgtgagatgggtctcctgaatagagcacatcaacaaaataaatagacagctagccagattaataaagaagaaaagagagaagaatcaaataaatgcaataaaaagtaatgtaggggatatcactactgatcccaccgaaatacaaactaccatcagagaatactataaatgcctctatgcaaatatactagaaaatctagaagaaatgcataactgcctggacacatacaccgtccaaagtctaaatcaggaagaagtcaaatccctgaatagaacaataacaaattctgaaattgaggcagtaattaatagcgtacaaaccaaaaaaaaagtccgtgaccagatggattcacagctgaattctaccagaggtacaaagaggaactggtaccattccttctgaaactatttcaaacaatagaaaaagagggactcctccctaactctttttatgaagccagcatcatcctgataccaaaacctggcagagacacaacaaaaaaaagaaaagctcaggccaatatccctgatgaacatcaatgcaccaattctcaataaaatactggcaaaccaaatccagcagcacatcaaaaagcttatccaccacgatcaagtgggcttcatccctgggatgcaaggctggttcaacatatgcaaaacaataaatgtaatccatcacctaaacagaagcaatgacagaaaccacataatcatctcaaaagatgcagaaaaggacttcaacaaaattcaacaccccttcatgctaaaaactcaatgctctaggtattgatggaatgtatctcaaaataataaaagctatttatggcaaacccacagccaatatcatacagaatgggcaaaaactggaagcatttactttgaaaaccagcacaagacaacgatgcctctctcaccactccaattcaacgtagtattgagagatctggccagggtaatcaggcaagagaaagaaataaattgtataaaaataggaaaagaggaagtcagattgtctctgtgtgcagatgacatgattgtatatttagaaaaccccatcgtctcagcccaaaatctccttaagctgataagcaacttcaacaaagtctcaggatacaaaatcaatgtgcaaaaatcacaagcatttctataacccaataacagaaaaacagagagccaaatcatgagtgaactcccactcaaaattgctacaaagaaaataaaatacctaggaatagaacttacaagggatgtgaaggatctcttcaaggagaactgcaaaccaccgctcaaagaaataagagaggacccaaacaaatggaaaaacattccatgctcatgaataggaagaataaacatcatgaaaatggccatactgcccaaagcaacttatagattgaatgctatccccatcaaactaccaatgactttcttcacagaattggaaaaaactattttaaagttcatatggaaccaaaaatacatcctgcatagccatgacaatcctgagcaaaaaaaaaaacaaagctggaggcatcatgctacctgacttcaaactatactacaaggctacagtaaccgaaacagcatggtattggtaccaaaacagacatatagaccaatggaacagagcagaggcctcacaaataacaccacacatctacaaccatctgaactttgacaatcttgacactaacaaacaatggggaaagaattccggaactatttaataagtggtgttgggaaaactggcgagccatatacagaaaactgaaactggaccccttccttacaccttatacaaaaactaactcaagatggatgaaagacttatccagacctgaaaccataaaaatcctagaagaaaatctaggcaataccatccaggacataggcatgggcaaagacttcaagtctaaaacaccaaaagtaatggcaacaaaagctaatactgacaaatgagatataattaaaggaaagtgcttctgcacagcaaaagaaactatcatcagaatgaacaggcacctacagaatgggagatttttgcaatctatccatctgacaaagggctaatatccagaatctacaacaaatttacaagaaaaaaaaacccatcaaaaagtaggtgaaggatatgaacagacatttctcaaaagaagacatttatgcagccagcaaacatgaaaaaaccctcctcatcactggtcattagagaaatgcaaatcaaaaccacaatgagataccatctcacaccagttagaatggtgaccattaaaaagtcaggaaacaacagatgctggagaggatgtggagaaatagtaacatttttacactgttggtgggagtgtaattaagttcatccattgtggaggacagtgtggcgattcctcaaggatctagaactagaaataccatttgacccagcaatcccattacttggtatgtaccccaaggattataaatcattctactacaaagacacattgcggcaccattcccaatagcaaagacttgaaaccaacccaaatgtccatcaataatagactggataaagaaaatgtggcacatatacaccatggaatactatgcagccataaaaaaggattagttcatgtcctttgcagggacatggatgaagctggaaaccatcattctcagctaactaacagaagaacagaaaaccagacaccgctgttctcactcgtaagtgggagttgaaccatgagaccaggtggacacagggaggggaatatcacacactgaggcctgttgggaggtaaagggctaggggagggatagcattaggagaaatacctaaggtagacggcaggttgatgggtgcagcaaaccaccatggcgtgtgtatacctatgtaacaaaactgcacattctgcacacgtaccccagaacgtaaagtatcatttaaagaaaggattacatattccattaaatatatatgagaaatcagagactcctgaatatacacatgaatacacactgggtctacctatatttttagggaaacactagaatacagcaaaataatgtcatgattttattaaaaaggggggtttatcaaaccacaccaggcatgtccagctctgtcctggagctggttcagggaacaggtgggtcctgtgtttgggagccatgacaacaagctcacagcgtcagttctagttgaaacctcaaaaaggcaaagggatctcaactaaaatatcatgtggatgtcacatctgtgggtgctgcatactcccccgatgtgaatatggaaaggttaattacctcttgaactctctgccgagattagtgctggtctctcaggaacacccaaaatggctcgatagagccagaaagcagactggctcagggtttttgtgatggtttcgtcgtgggtcagagtgaggcttcccacgcacaggaaggggattgtacagtgcgaaacacccactggtgtcaaatgaggaagctcccgcaattcctaactagattcacattgtgtgataaaagacacacaatagacataacttcatggtcggatatcacaaaatgccgttaaaagatgtggtaaaaaggcaactttaaatttttagtcattggagtgcgtacaacacaaaaatcattttcaatatttgtaacacatgcatgcaataggacaaaggtatgtgatgagggtaaaatctcgaaagtgtgaatcttccagctaccaagtcgtagggtaataactgatgtgtgctgagggaggaaaccatcacgccatagtgctaatggtataacccttggtgaagagagttcaatattttattgaagttttcataatttttatttaaagatgccatttttcaacatactcagatgattgtgagtgccattgattctgtatcgtatgaacaatggcaataccttccatgtttacataatattaaaaaccacgttaagactgaatatttggtgtcatggtgcatcacgttattctagcttccatactagttgttttatttgtttgttttctcctttgttggcatttggtttcgaattcatatgtcaggtctctataatgtaggaatttatttaaaagtgtctttttttgtccattttgatggggcttccaggagacgtaagaacctcctctgcttgcaacacattttaaaattacacactaatgtagaacatctgtatttaatcctggtttttagttaattgacaagctctaataagtgaagtaacttctccattctgggctgattttacatcaggtataggaatatatcctaggtgaaagtttgtaccagtaatatgaattattaggtaataacctccacctttatgatttacatgttattcatcaagaaatagtgttaaatcaggagtctcaatgaaagtattacctaagggatatacaaaatatattgctaatctacataaaacagatgtgaacacactcttagtatccagccatgtttcctgtcaaccacacagtaactttgacttcacttgggacttgttctaattttcaaattagttacttattaatcttaatgcttctagatattatgtgtgactattttagcagagagtgaagaaagacagcctaggccgactaaacaatgaggaaaatcacaacctgatgaaacaggaagcctctggatgtgagtggctccaggattgaataatttgacaactcatgtacccaggaagtttcttttctcaattttccacactgatgcatccagaaagtcagcttcaccccccaggtgactcccataatgcagtgacatggtgacaatattcccatggtcacatacgtattttatatattggctggaaaaggggcagagacagttctgcaattctcctctgaaggaccaggaacacctcaacagaccacctcccctgcccccatgactagaactgcaccacgtgcccacatggacactcatccctgatggggataagaagactccattgatgaggccgactattttagcatataaattagtaaagactgatataaaggtttcaacaactaattgaagtctgttcttctatgtccaccagagactatagatgctccagcgatatcttgtttttctttgctgcgtgactgtgtctcttctccttgttccatcctccagagaatctctttcagctcccacaggtgcattcctctgttacatgtaactgacaattgataaattagtggaagcccttacactaaaggaagagtctctgacctcatcttggtccatattcctagaaaggcattgtgcccgtaagtctgggtgtgaccttctgagtgttcctgaccctcctccagaggagatgctcatctgtgtgttcttgtccctttcactggggtagaaccaccctgtttcccccaggtgttccctcccacagctccagtgttccgcatcagtgtcatcacctcccagatctgctgccctgccctgcagactaaagctctgattccataagaaggagagttatgtctcaacagaacttcgtggcagtgacctctgttcccatctcaattcctgaggggttgcaccagtgcccctagggtactggttttggtggttcccctgcaaagtaatttttggttctgtagtggatataagggagtcgagtctgaatgcctttcaaaaatgggggctcttgttctctcccagacagacactttgggaaaggaagattttgtgactgccccttttttggggaaagggattcaagaggatagaaaagctcttcagtatgtggtcccttagaatttcaaactacaacaagcttaccatattcagtttcaagcaatcccatatatatttgtatttttatctttaacagactatatttcatatgccagactctgccttaggtaatctcatatgctggctttgttactctctacaagaacttgcttcttgttaaatttaagattttttttaacttcagttatcctaagcattcagaaatttgcaaaatttcatcttgactgtttatctgttattgttgatgtagttgtaagaaataaagaatatatatccctcatttatgtacattttcaagtcgagtagtagatttttagtactaccagagtaataaaataatttgaacattgttaagctgcttaacagaaaatcaaattatggtaaatttgttcaatggaatactacacaacatttataataaataattgtctgatacatgcaacaagaaggtaaaatatctaagtatttttgctgagtaaaataaaccagacaaatgagaagatttaccatataatttcatttatataaattctggaaaataaaaactgaacttacttaagtaatataacaacaaggtaaaatatctaagtattgatgttcaggaaaataaagcaaatgaataagaatatgtactatgttattccattttaataaactctgataaattaaattgaatctacagcaatataaagaagaacagaatttaccatttggggaaatggtagaagaagggaagaggaaaggaggaggaatatagaagaatgagagggaaattttgtgaattttctggttcaccttggtaactaggatggttacatcaggtttatcaattgtacactttaaatatgtgaagtttattatcagtaaactgaaatttataaaatttattaccagcaaacaaatgaaaacttgcacaagaaataagtgacataaagatagaaaaaatattaaatttcagaaacacctaataatttatcttcgtgaaccctagttctcaccatatttttaggtgaatgctagaatgcagcaaaattacacatgctctcaatacagaaagtgggtttcacaaaccacactaggcatgctcagctctgtcctggagttgggttagggagtaatatagggccagtggatgaggagcacaggcctagatactggggctcactaacctcaggtatgagctcttagatacatacaaagcccctccacgcatgggtttacttccccatctgtaaattgagaaaccattgacccctaaaaatatgatttacacaaatatgtaaaaatgtaagagagtgattagtgcaaagtgtttatcacagcacaatttcataacaagacagcaagttttccaaacagcatcattgtcattagattcctgcagggcatcattaccttatctgggccctgccctctgttcaggcatcccaccccagagcttgctatatagtaggtgacatgcaaatagggccctccctctcctgatgaaaaccagcccagtcctgaccctgcagctctgggagaggagccccagccttgggattcccaagtgttttcattcagtgatcaggactgaacacagaggactcaccatggagtttgggctgagctggattttccttgctgctattttaaaaggtgatttatggagaactagagagattaagtgtgagtggacgtgagtgagagaaacagtggatatgtgtggcagtttctgatcttagtgtctctgtgtttgcaggtgtccagtgtgaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagacacagtgaggggaggtcagtgtgagcccggacacaaacctccctgcaggggcgcgcggggccaccagggggcgctcgtgacccactgagggcgggacaggtcccaggagcaggtgccgggagaggtttcctttctcctcagctggaaaagtcaggtttatcttcgcaggactctggagtcttctaggctgtgatattttgttacttatatttattatgaattttatcattaatacttaaattttagtaattattaacattctacatattattatatttttaagtatatactttcaagaaataaacattcctaattgcataataattattgtaacataattattgtaacatataattatatcctaaatgcataataattattgtaacaatcacattctcattttgtatttgaattttcatatttattttactaagattttaattttaatataaaatatttttctacaattgtctgttttccatttttgtgagataaaattagcatatacaaaaatgcacagattctccaggtacagttagagggtttcaggcaaatgtgcacatacttgtctacagcagctaagtgagggtgaggaacaggtgaggtccatctccccacaaagtgtcctcttagtgcttccagttagttctcacataaggatttttttttatttcaactttataatttagatacagagggttcatgtgtggatttgttacatgggattactgagtgatgctgaggtttggaatacagatttcttcaccccctccctccatggtctagcagtccacagtgtctgttgctcccatatttatgtctatgtgtgctcaatgctgaggtcccacttacaagaatatgtggtgttcagttttattttcctgaattaatttgtttaggattaagaactccagctccatttgttttgctgcaaaggacatgatttcattctttcttatggctgtgtagtattatatattttacatgtaacacattttatatatccactctaccattgatgtgcatctgggctgatctttgtctttgccactgtgaataacacagcaataaacatacacatgcatgtgtctctttggtagaattatttgtttaccttgtagtgtataccctgtaataggatagctggttcatataatatctccattttaagttttttgagaaatctccagtctgctttccaaagtgggtggactaatttatattcccattaacagtgtgtaagtgctttcttttcaccacagccccatcagtatccattggtttttgactttttagtgataaaaatttgagtggtgtgaggctgcacacctacaaccatatgatctttgataaggctgacaaaaaaacaagaaatgagaaaggaattccctgttccataaatggtgctgggacaactagctggccacacgacaaagattgaaactggatgtctgctttcaacatatataaaaattaactcaaaattgataaaagatttaaatgtaagacatcaaactataacaatccttgaagacaacgtgaaaatactcttctcgacaccagctttgacaaatactttttggctaagtatgcaaaagcaattgcaacaaaaacaaaaatagataaggagagactaatttgctaaagagttactacacagcaaaccaaccagctaatcaaccaaacaaacaaataaacaaacaaaactatcagcatagtaagcagacaacctacagaatgtgggaagttattcacaaatattgcatccaacaatgccctaatatccagaattgtattagctggttttcatgctgctaataaagacatacccgatattaggaaatttatcaaaaaagaagaagaagaggtttgatccacagttccacaaggctggagaggcctcacagtcatggtggaatgtgaaaggcacgtctcatatggcagcagacaagaaaagagaacttgtgcaggaaaatccccctttataaaactatcagattttatgagacattcactctcaagagaatagcatgggaaagacccacccccatgatttaattatctcacagggggtttattccacaacattaggaaattactgaagctccaattaagatgagaattgggtggggacacagtcaaatcatatcattctgcccctggctcctcctaaatctcatgtactcacatttcaaaatggatcctgccttcccaacagtcccaaattcttatttcagcattaactgaaatgtccgcattccaaggcctcatctgagacaaagcaagtcccttctgcctatgagcctgtaaaatcaaaagtaagttaattacttcctagacacaatgggagtacaggtattgggtaaatagagcaattccaaatgggagaagttggccaaaacacagaggctaaaggccccgtacaagtccaaaatccagtgggacagttaaatcttaaagctcaaaaaagatctattttgactccatgtctcacatccaggtcatgctgatgtaagtgttgggttcccatggtcttgggcagctatgtgcctctggctttgcagggtacagtctttcacccagctgttttcaccggcttgctctgagtgtccatggcttttctaggtgcatggtgcaagctgttggtggatctactattctggggtctgaataactgcggccttctaatcatagcttcactaggcaatgcaccagtggggactctgtgtgaaagcacccaccccacattttctttcctcgctgcccctaacagaggttcccatgtgggcccctccctgcagccaccttctgcctggacatccaggcatttacatacatcctccgaaatctgggcagaggttattaaacctcaattcttgacttctgtgcacttgcaggctcaacacaaaatggaagatgctaaggctcggggctttcaccccctgaagccacagcctgagttatatgtaccttggccccttttaatcatggctggagcagctctgatgcaaggaagcaagtccctagactgcacacagcagagggaccctgagcccagcccatgaaacaattttttcctcctaggtctctggcttatgatgggagaaccttccacaaaggtctctgacatgccctggaacattttctgcattgtcttggtgaccaacatttgggtcctcgttacttatgtaaatttacgcagctggtttgaatttatcctaaccaaatgggattttattttctattgcattgtcgggctgcaaattttctgaacttttatgttctacctcctttttaaaactgagtgtgtttaacagcacccaagtcacaccttgaatactttgttgcttagaattttttactgccagatacctggtatcatctctctcaagctcaaagttccacaaatctctaaggcagaggcaaaatgccaccagtctctttgctaaagcctaactagagtcacctttgctccagttcccaacaagttccttgtctccatctgaggccacctcagcctggattttattgttgacatcattatcggcattttggccaaagccattcaacaaatctctagagagtttcaaactttcacacattttttgtgtcttcctcttagccctccaaactgtttcatcctcagcgtgttttccaattccaaatttgcttttatgcttttgggtatcttatcagaagcacttcactcaactgataccaatttaccgtattagttgcttttcatgctgctgataaagacatacctgagactgggcatttacaagagaaagaggttgaatagactcacacttccacgttgctggggaggcctcgaaatcatggcagaacatgaaaggcacatatcacatggtggcatacaagagaagagaggacatgcagggaaactcccctttataaaatcatcagcaagacaggagaactcatgcagggaaactcccctttatcaaatcatcagatctcatgagactaattcactatcatgagaatagcatgggaaagacccccccccaccatgattcaattatctcccacggggtccctcccacaacacatggtaattatgggagcagcaattcatgataagatttgtgtggggacacaatcaaaccatatcaagaatgtataggaaacttaaacaaatcaagaatcaaaagacaaataaccccattaataaatgggcaaataacaagaacagacacttctgaaaagaagacttacaggtggccagcaatattttaaaagattctcatcatcactaaccatcagaaaaatgcaaatagaaaaatgttctaatttttgtcattatagattgattttttctgttttgaacttatttttgctattttttaggtttatttatgtaatttcatgtctcaaggttttgtcattgtatatatacatatgtatgtactaatacacatatgaatatttcatatctgaatcaatccataacatcagtaaatgacagtttattaagtaaataaatcagtttattatgtgaaataatgacgatatgtatatttgttttcctgttgatgaaatttaaatttgtttccaacataaatattataagcaaactgttataactatttttgtgcaagtttttctgtttatattctcacatattgataaaatatgtagaaatataagtatgcttttttattataagacttacattttcagctttatggagctaaagttgacaaataaaattgtatgtatttaaggtacaccacttgacgtattgatatacatgggaaaatgctggatggtagataagtaaacaatgctaaacagcactaattatcagggagatgcaaattaaaactgcagtgatatttcttaaaccagtcagaacagctactattaaagagccaaaaataacaggtattggtgaggattgaaggcaaaaggaacgcttggacacttgtggtgaggatgtagattagcacagcctcgatggaaaacagtatggagatttttcaaagaagtaaaagtagaactactttgattcgataaccacaaataactacctaaaggaaaaataaatcattatatcagaatgataagcagacttttgttttcctgcagaactattcataatagcacagtcatcaaacttaggaattaacctatgcctaacaacagatagttttataaagaaaatgttacatatatatacatttaaatactatccagccatattaagggatgcaatcatatcttttgcagctacatggatggaattcatcattattttaagtataataattgagaaacagaacatcatacaccacatgttctcacttataaatgagagtgaactcatatgtgcacaaggacatagagaaaggaatgatggacattggagactcagaaagatgggagagcaaaaggtgggagaatggtgagaaattacttaatgggtatgatgtacattatttggatcatggatatgttaaagccaagactactatgcaatatatatatgtaacaaaattgcagtcactccccataaatttatacatataaaataaaaacaaatacaattaaaatgattaacagttgataaacaatactgaaaattaaaatttgtgatcaataaatgaaaataatattagttgaacttcaaattttaaaacattttctactcaagtgactatcaagaaaattaaggacaagctgcaaaggaaaaaatatttgcaagtcatatatctaccaatgtaattataacaagaaccggcaaacctcaaagatgtacagatgacacatcagcataggaatgtgattttccaccagagaaatgcaaatcaagaccaaaaggagacactactatagactttctagaaagacaaaaaataaaaaagaaatactgacaatatcagagttggtgaggaagtcagtcaccctagagactaatatattgctagtgggaatgcaaaatgaaaccgtttctgggaaaatcatttacagtttcccataaaattaaacatgtccttaatccatgacctagaactctcactcctaagtatgtcctacaaaggattaaaatcatatgttcacacacgtattcagatgtttaacattgtgtgtgtgtgtgtgtgtgtgtgtgtggtgtgtgtgtgtgtgttagaaactaaaaacaacatggacgtctttgaaaatttgacacaaaccattacaggtgaactccagactttcttctgagtgacagaaggcctgcctgaaagatccccagagacacagtcgtggatttcactgtcaccctcgcatgtcactggcttgggctgggctctctctggctcttccctgaccaggaccagatgttgagctccactacctgcagttggaagtttatattttcaacaatgcactgaggtctaagttgctctgcagatggaaccaaacaaacatgggcgcctttgaacaaacagtgcctgacatttgtactgaccccaggagaactcttcccagctctcattcttcttggttctctcctgcaggccagcagccctgaagtttagcctggatctcccatgcatccacccatctccttccaagtgcattttaccacagcctccactgtttttgaagcactcttgggctttgtaattctccacactctgttgtaaaggaagtcaggtccttcaagaccagattcgggactctattttatgaccaaatttcagcctcacccctgctcctgagagagagctcctagataagattctgcaggtggagattaggagtgtttttcttcttcaatgtagttgctgagcgctcagtgcagggttggggagaaactttccactttgtcagcatgcagctcctgctggggtagaccttcttccatagaagcagggttgggaaccagggggccaatgtcctcagtgctgctgcacccagggcagagccttcatccatcagtggggctgtggaagaagtgagtctctggttctcagtagctcttgtccagaactgagcctctgcagcatgttctgtcggccccagtgtcctggcccctaaggagcagcatcctaaaatgggagctagcatatttgagaataacaacacctacacattcagaagctctttggctttctttccagctaatataatttccttttttttgtgtagcaacctgtacacacgcatattgatgcatacagacctatgacacttttttctcgataagtaaaaaattattgatcactgtgatcttttctccaagttcaccatttccctgaaggtgagcacaggtccttctgcatgtgttcaaacaaaaggcccagagactacctggtaagtgaggtgctcacctggttctggatgtttggtctgtctcctcccctctgttgccccacacaaggtcagcccactctttccaggtccgaagaagagagcacaggtttgtcctgattatatgactcacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggagctgagcagtcagagatctgaggacatagatgtgtactactgtgcgagacacacagtgtgaaaacccacatcctgagagagtcagaaatcctgagggaggtggcagcagtgctaggcttgagagatgacagggattttatttgctttaaaggctttttttagaaagcgaggttaattcattacagaaaaaaggaaaatagaaatgtgtatggactctaattatgtgggaaattttccatacaacttttgttctctaagcaaaattcagggagtggaaaacaaatcaaattaataaacctgataaaagaattcctctgaaaatttagtgtgagcataagtttttgaatgggtgttgtaaatattttggaacacagctgctagatcacattttaactctacacttatctccattatataaaatatcaaaatgttttaatgttttccattttgtgcaattataattttgtgttataatcacattttaacactttaactctacacttatctccattatataaaatatcaaaatgttttaatgttttccatttcgtgcaattataattttgtgttcatgccagcaatgcatgatagatcttgttcttccgcatcctcattgccatttggcactaagagtattgtgtattttaatattctaatagattagtagtgatagctcattgctgtttaaatgcacatatttctaattaaaattttgtatttaattattttatataattgtgatgaagtgtctcgtatggtatttggattattttttattgcattgtttctttttgatcagttgtaagtttccttatatacccattatataagtcactcacaaagttaacaaaaaattgattaacaaatatgtgttttacaagtgtattctccaaattgttgttgtcgttttactcccatatcagtgtctgtgggagaaaaatatttatatacatatatatgtgtgtgtgcatatatatatatatatatatatagtgtgtgtgtgtgtaaacttagataaaataattatttcataaatcatacttttggcatcatatctaaaaactaattatgaattccactaacaggatttttctcttgtctccaatctcaggccacaatcacagcataagcatttaaatttctcctatttgatgagaagattattaacttaagatgtttagaattcttctgaatggaaggtgccttttttctaattttctgtattcaataatctgttaatatcagtattggctcatgaatgtttattttttactatggagaagatctagtgctacattatttattttatcgctcaaatcaccacagcttttttttaggttctgtgagctcatttagtttggattctgtatttttacagcatgccccatccttttgtttttgatcacttccctatttcctggtattacaagaaatactaagctcattatctctattatcttttccacacatagaatcagttatttctccaaggattactggtccctgatattaaagaattatattaaaacacaaaattatgatgttggatgtgtgtgttgttaatgtactgtcagtgtttctagaatctctaagctaacaggcctagaaaatgtgtatgtgtatattaacccatgttaactgacccatctaatctatttatgtatccaatcttctgtatgtttattgcatcaaactttagaacactggtatctacaatctactatgatgatacatgaatgtttcaagccttccttccttgcctgtccataccacctactgcaaagtgaggaacccctcccatcatttgccgttcattcaatttgttgtacaattttagaatatatgcgtcgtggtattagaattgttaacttgtacccctgttggaagtatgtttattgactagaataaagtgtttaagtgcagtttctttatactttagacttacagaacaccctgagttctaagttatataggtgagaaactttatgtgccaccttcttcagtgaggttatttgaaatatgttgtatacattttatttgacattctgtaaaagacaaaactgtagatgtcataaatatatgaggattttctagaaatttagagagagggtatgcattaggagaaacaggtactgtttgcaaacagtgaaattttttatgatctgcagtagtgaacacatgacacaatttgttaattctcacaattttatgatgtaaactgtgaatctaaatatatacaacttacaaaattatgtagcacatcatgaacatgcaaagtgtacaaaaataaaatatcaaatacatttacaccgcgtgggcagggaattgcatgagatgcaggcaacaaagaatgaagtaaccttccccatttgcacataagatgtttccattcacaagagacctttcttttatcaggttcatgtgcaaccaagtttccctgctgacaagcatttaagccagatgattcgcaacttcctttgactgagaaagatttccctcaaacttcagctcagtgcaggcacacaccatctctgaatgggcatttaccatcagacaatgcccacacctgtccccacatggacctttccctcagacaaacaaacacatcctcaggttgactcttccctcagacaagcacccctgtcttcatgtgaactcttccctcagataagcacacatgtccccacattgactttttcctcagacaagcacatatagctgacaacgaacagttatgtggcaaaatgagctcaggatagtggtaattatggactccagctctgatagtttgtagaaattgtcatttttaaaattctgactgaagactttcctttattgtagaagacagtcctttacagctctaattgcacagcctacagacaggagtccatttcctctgggcaaggtttatttttatttgtttactgtacttatttgttgataaatattgatactacaaagatagcctatagggtccacatacgagaaaaaaagagtaatgggcagatcaaccctgcaaatccagtcccaggagtctttgaccctgccctccctggaatccagagacagagatgggaagaggcctgctgagcagtgcactcatgtccccagggagaaagacatggaaatgaggcccctcctctgcaaatgaaaagtagctcatcccctgttcctgtagatcctggtgaggagccatcccacatctgtgcccttcctcagtgtccacaccatggggtctgtgcagatctgggctgctcttgtcatcactctcaatgttcaggttccccgtggatcaggccctgctgtggctgttgcctctgtgttttcagaagtcccctgtgaagttaactaatggagttagacagagaaatactacagaccaggaattctgccttttctgcaaagcctctggattcactttcactgaaaacagcataagcttgatccagcaggcttcatgacaggggtgggtgtgggtaataacaataattcaaatagaagttctcagtgggactctccttgagtaaaaagatgattaacaatcctcaaatacactcagttcaggagattctcttttaagatgattaacctgagagctcaggaaaagtccgtgtattactttgagggacacagtgaggggacatctgtgtgaactcagacaccaacctccctgcagggagacaggaggggactgcctggtagatgcttctcagaaccaccagggggtgctcaggacatcagggggcactcagaaccatcaggggatgctcaggacaccagagggcactcaggacactggggggggggtgtcactcagaaccaccagggggcactcaggacactggggggggggggtcactcagaaccaccagggggcgctcaggacactgcggggggggggggggggtcactcaaaaccaccagggggcgctcaggacactatgagggggggtggtcactcaaaaccaccagggggcgctccggacacggtggtgaggggtagctcaggatagcaggggtgctcagaaccaccagggggcgctcaggacactggggggggggggtcactcagaaccaccaggggacactcaggacactggtggcggggggggggggggtggtcactcagaaccaccagggggcactcgagacaccagggagccctcaggacactagggggagctcagaaacaccaaagggcaatcaagacaccagggggatctcagaaccaccaggaggtgctcaggacaccaggggtctctgaaccactagggggagattaggaccccagggggctcagaaccactagggggttttcaggagaccagggggcgctcaggacaccagggggcgatagggacaccaggtggttcagaaccactagagtgtgctgagaaccaccaggggtgctcagaaccccagggggctgctaaggacaatagggagtgctgagaaccaccagtgggcgctcaggacaccagggggatctcagaatcaccaggctgtgctcaggacaccggggggtgctcaggacctccaggagcgcacacgacacaaaggatagctcaggacctacagggggcgatcagaacgccagggtgcgttgaggacaacaaggggctcacaggacacaacgacgtgcttagtaaaccgggggacactcacaaccaccgggggtactcaggacaccagggggtgcccaggaaaccagggagcactgaggacaccactgctcccttaggaggcagctccacatcaggtccctgagtgggagcagggaggagggttcctcttgtatcttgccactaacatgttgggagtttttctgcttcctttgtggtttcaattattggctgattcttcggtacaaagcagagcaagtataaagctctgctttcttggattatgtaatgtttttggctttggatgctaccagaattacattgtactttgagaggattcattcatggtgtgtgcaatagtgaatgaaacctgtaattttaggggtggctttgaaagctatgttaggtgtggctgagggcagtttacaggaaatggtcatcactatagaaggctactcatttctttgcacatttgcgtaagcaattgtagtttatgaattaaaaactgcctgttttcttggtcctttttcttaaatggtcccactctaagggcagtaatgtaatcaagctgtgtttcaaagatctgcaatcaagttaagtctgtttaatgaaatgctttgtaaagaaaatgtacatctattttttagagtcacctttacattttacattgctttacaaatattaatttggtaaatttagtctcataattatcttcagtaattaaaaatcttaaagtcatgtcatgttaaattaagtaatcctaggcttctcactgtgaattagggttactaaaaattagaatagtaagagagtataatcaatttatggtgaagtttattaagaaagatgaagatatgttttttgcttaaaaatattttgttttccagtttacagggcctttctactggttttaagatgacaaccactgtttacatctgacccttttttgttgaacatctgttgagtttctattgatattccacagctagagttttaaagtaaaagctctagtatctttgtattagtgtgaatgtgtgcttgtatgtattatgtacatatatatatattttttgttatgtgttatggctacaaggtacaaaattgactttaaaataaataactattttaaattaagtcaatgagccctaatgcatctgaagtacatgtaacttaaataaatatgtaataaataagctggcttcaaaattattggtaaaataaaattggaaatattttaacaattattagaatacctcatagtttatatcaattgatcaagtgattttatatttaaaatcacagctagatattatatggtgtgaaacatttctatgaagattataaaattattaacctagttaaaaccagaatgatctttgtaatttgacaaataagatgtttaatactgttgttttaataaaaaacaggtaaatagttattggaaatacaatcatttatttaataagaattttacttaggtaaacacctgaaattcatgggttataatatgggtaacagggaaaaaactttaaaggatgagtattactgttttcataaatgatctaggtaagctatttaaaaaataaattaggttaatgtaacaaaataaaccttttaaataaacttgttctacaatttaaaaatctaaagtttaattaaataatagatattaactaaatgtttaggtcattactaattgttttaaaaaatgtatactataagaaaatatttttgtaaaaaatttgttcttacagaaagattttatttaattcagaggttacttataaaacatcctaaacataaccagtaaataagagagatgccactgcactccagcctgggtgacagagcaagattctgtctcaaaaaaaaaaaaagaaaagaaatttttagacatagaggagtacttttggtatgaaaggttaaaataaaaaaaaataattttatatgagaaagaatcttgtaactttttatcctaaaataaaaatgactttatttaagaaacagtgatgtttagaataaaactatatgctcaagtatgccataagcgttttgtgtaagtcaaactaaggtttgtaaaaagttaattaattaaaataacttcatattatgaagttgactataattaaaaaggaagtatttataatagtctttatagatttgtagagatctggctttcatataaaaatatataaatatactaaagattggttaggaatgaaaaattgtgcttaaagtattgatttactcaataaaattataagatattttaattttttaacccaaaagtttaactcttactgcatcttgccagttttattttattctcttttgagaaggcttgagaggatctcaaatttttcatgagctcctctaacattttttttcttacagcagttagcctctaacgatgttaacttctaactgttgttagcttctaactgctattattgcctgatgctaaaaatcttttatattaaagttcttaataaaatgttttatttcaatatagtattctgcactcttgggtttttttaaatgtctatatttgtctatggaaccaaaatcttcacttgtaatccaagacacattcttcctatgtctaattaatcaaatactttgtttcattagagttgacttgcaggttatctgcatggatttccccacagggaaacacagtcacactgctgaaggtgttttttcccatttggtaactggcataaaacaaattttatattttcttgaaatacttcctctgtagctgtttttaagtttttcaactacttaggaatactgagattttgagaaaatataaattattgttattacgttaatgtaactatctggcataacttttaaaggacttgtcctgctacattactgatctttgattcctaggtctaaaaaggatacacaacactttgggaggcttcagagggtggatctcctgagggcaggagttagagacgaacctggccaaaaaggcacaatctcattttaataaaaaatacaaaaattagctgggcgtggtggcgggcgcaggtaatcccaactacttgggagcctgaggcagggagaattgcttgaacctgggaggcagaggttacagtaagccgagattacaccactgcactccagcctgggtgagactctgtctcaggaaaaacaaataaatacaataaaaataaaaaagacaccgagtcttgctaaattttaaactctgacagcaattgaagccccatctagagatgtggaagaaaatgacaataaaaattaatcacacacttaagacacaaggccggaaaattgaatctactcaaccactccaggcccagggactgttacagaagaagcggtttgtaagattgtaaaagctaattttgaaagatgaaattacttgagagtttctttatacagtaaacattaatattaaaggcacactaatgccaggctagtagctgggccatgtgtcagattgacaagggtttcttgaagaattaatccactttttaatttgaaaaacttataaaagtttataagagatcatttgaaattaaattttatggtaaaagtaattataatgtaatagatttatttttcagaattgagagacagttttaacttctctcatgctgttcttataaggggctattgtttagaaaattaattcttctctttgaaaaataaaagtttttgctttctttcaaaatcactgagttctcactgggctaaataaataacttacattacagcaatctgtaatcctattttgtaatatcaagcattgtaaacttttgatatttgacaaacttcacaaaataaaattctaaattcagtcatttgacctcattattcttttatgatattaggtccccaaagccaaaattaaacatattcagcttatttggtataattaaaatatgcaggaagcaatgtcaaatttgcaaaagtgtttaactttggactatatttaaataaatgtggactatataattggactatatttatataaattaaagagtatattttccaaaattgtatgagattcaagtgatttgatatgtcttagtatattttatcagtagtatttatgattattatgtaaaatttctgtttattgccagaaataagcaaatcttctcctcaattctgtctttaaccatggctattctaaaacttcagtcatccacagttggtgttttactttgattctttatcaggtggcttatagtaatctatagaattttgaggagtactcaaatatacgattgtgacaattttataaattgtgccattggtatagagattaaaacttccatgactctcattgatacctgattcatttatgatgattgttaatctaatattaagcaggacaggacttaattgcatgaactgaattgacagaagactgaaattgtttttatggcttattctttaatgcatttgctaattacttatgttctgttttttcagaatcaggaaaagtttgtcttttaagctcttcacagttgttaacaattgagtatggtatactttactgataaaaaaataaaaacataatatcttcttatttacataatttctccaaaatttggaaactgtgagtattcttatatcaaaatagttatttgcataggttcaataaaaacctgctttcttccataacagggcacaattggagacaatggtcattttactaaggctttaacttgaattatatattttcagatttactttataaaatgaatctaacctggagagctgataaagccccttgggaaaactggcatgcacatttttttttttttacagggccccgaactgtagtaagtaaacaatttaatttctgacagacccaggactcccaggttttcttggaaacttgaaaaaagagaaagtaacccaattcacatagctatctggtggcacagataaaatattggctgggcttgaagattttaaagattctaccctttgattccttataaaaaatttccagcaaagtcaatttatggaataaaattggcctatgtacaaacaaaaaatagaaaacaaaaagagagctaatatgttaaagggttactttggctggcatcttatacaaaaaaaccagggccaagtctcataagcctaaaactgattttacaaatagattagtcctactatgattttgtgtctaataaaattggggaattatagagagaaatattatttcaaaataaactatagtgcatcagttaatagattttaaccttgtccacttgcttttcaatttatattattttctacaatttggactgaattttaaagcgtatctttgcacgagtctccaaaataatgttttcagttatttccctttttaaatatttttcctggcttgaaatcagcagaagttaaactgtgctttcttacagctagacaatgtaaattctaaaagaaaacaaaatcaatgatatggtttggctccgtgtccctacccaaatctcaccttgtattgtaataattcacacattgcaagggtggaatgaggtggagataattgaatcataggggctgttttcttcatgcttttctcctgttagtgagtgagttctcacaagatttgataattttatgaggggcttccctcttcacttaacacttctctctcctgcagtcatgtgaaatagcatgtgtttgctacccctttcatcatgattgtaagttttttgtggcctccccagccatgcagaactgtgagtcaattaaacctatttttctttaaaaattacccagcctcgtgtatgtccttatagcaacctgaaaatggactgatacaagcaacttaactacatacgaagtctccttttgtacctgcctattgtgaagagaaaataaatcttgagaccccaaaatcactaagctaaagagaagagtccagctggtgtaataggagatagaaagaaattatttaggtagatagttaggatgaaagagtctctggcaaaacttttcttctcacaagaattagctcagaaataacttcttttctaatcagacacagttcaaagagatcacttctaacaaagagcagcctgaaagatcgggctgtaaaacatagataaacaactctggcagagagggtatttctgtgtgtaatcaccaaagttcacatacataggatgggtcccaataaaaacattgggtcttaatgagcacattcctttccttttctggggtcacactgagataggaaagctgttagcttgcacggggtttgggatgcctccagctgcaaggaggtaccagggacctggcatggaaactcctcccccctttttcagcacatgcatggtggaaggagataaggaacgtggagcagaccaagctaagtccccacctgcataataaaagcatgagatggggctgccagagacttcgctctctgcagatggcacacctggtcctgcttttgcaccttatgttgataagaagccatctccccacgagcacatttataaaaatccttacgttgataagatactgtctccccacgagcacatttataaaaatccttacattttactgcggcacagcaacccatctgggaccctttctgtgacagagagattttttttccttttacacattaaatttctgctctaacctcactctttgtgtgtctgtgtccttgattttcatagccacgacacaaagaacctttggtgatattccagataacaaaggtgctttactggagagggctttgggcaacctgcctcccattctattcaaagtgattcctctgaggcccacacgagacagatacatatctgattgcttcctcttcagtatcatttatgaaaaaatgaagattcactaagtctgactaaattgtggattcagtggtaggctgataaaggacttaaaataatgcaacctactgtgtcttatctacttctaaactgcaaaaccccctttcaatttgtcctgtcttgaaggaaaaaaaatgtacattttacatatattgattgatgtctcatgtctctctaaaatgtataaaatcaagctgtacttcaatcgccttgggcacatgtctcaggacttcctgaggctggtcatgggtgggttcttaactttggcaaaataaatgtattagtctgttctcctgctactaataaaaacataaccaagcctgggtaatttataaagcaatgaggtttaatggacttatagttccacatggctgggaatgcttcaaaatcatgtcaggaaagcaagggacatcttacatggtggcagacaagagagagcttgcacaggggaactccccttgataaaaccatcagatctaatgggacttattcactatcatgagaacagcatgggaaagtgctgacttactgcaggagaactacataattttatattttcctatatgcttctttttcattacacatgtaaattttcataccatccaaatttccccttacccagcttttcctctttatatattgaaagccctaaaaattgtctttggggaatggcactaaccacacacagtttctgtgattacttttatttttcttccaggcatgtcctggaaagacataatttcctttgggaaaattaattttaatttgattaagatctgtctcagaaaccttcggtttacactaggaaagatcccaaattaggagccaattactgtaaaaatcagccataccactctgtgagtgtgtgtgtgtgtggcggggggtgtatatgtgtgtgtacatgcatgttttcatttctgtgggctttaagccatgtagttctctctgcgaagatactatttggcatgacctttgaatagagaattgtaagagaaataagaggctcctatgaattatccgaaagtttctggactcaccatgtatcttgactgtgtcattgcatctgacagtcccagggaagtgactctctggtggtttcatgaatctgtgcttgggctctctctgcagtttactgggtatagtaatgacaaatcactgtttcaagagacaatttcgaaagcattagatgctgctgagagaggattatgaaccaggggacagccccttcattctgggggagcgacattgggagaatatgctctgtgagcccaaacagcttcctcccctgcagggtgagggcagagctgcaggacaggcccagaacccactcaacacagatgtcagccctggagctgctgcagaggagtctgaggagaaaattttaccagcacctgaattacacttatttcaaacaaaaatgcatgtcctgtgagtgtttgtttccctattggaggagttctgtactcatgaagttctggacatgccagcggacaaatatcagtaaacaaacatcagaacttgaacctcagcttcccactgttgcattctccatgtgtcatctctattatttctcatgctagatcaggtatttagctatgaaatattccagctaattaacgtgtaaatagcttgaagtctactgagttaaatacatatattttctcttgtttttgccaggtgttccctcccacacctccaatagtctccactattatcatcatcttctagatcttctgcgatgccctggagattaaggatttgattccatgacagagaggaggtgcatttcgatggaactttggtgaaaaccttggtctttatcccatttcctctggggctccaccagtgcctctggaatcatggtttcagtggcttgcccctgcatggtaggtcattcctttattctgtagtgctgatgagggaggtgggtctgaacgcatttcagtagtatgggctctccttctgtctcagacactttgggaaaggaaaatttttctgagcgtcctcattctagaacaaagggattcaattgtataggaatgctgaaaatagaaaaccttcagccaaattaaggttaataagattaattgagcaatggatgattcatgaattgggcagcccccagaatcacagcagattcaaagagacttcagtgcagtcacggggtggaagaagatttatagattagaaaaatgatgtacagaaatcagaagtgaggtacagaaacagctggattggttacaggttgcttttgtcttatttaaacaaggtgtgcaccctcaagagtgtacgagtggttgaggtatggctgctggaattggccaagactccgctgttgttacaggcgcatgctccgaagttggcttttcaatctcgtccacctattcaggtaggttacagtttgtccacaaggactcaaacacagaagtacggagtccttttcaggccatatttaattcactttatcagtgcccttcagtatgtggttcctgagaatttcacatgacaacacgtttaccacactggaatttaagcaatccaacacgtttgtagctttgtcttgtaatgggctatatttcatgtggcagcctcggcctcagtttagctaacactatggcttcatttctctctacaagaactcatttcttccaagatttccatgttcctgaaaggaaaataaacctttgggacccccatatcactaagccaaagggaagtcaagctgaaaattgtttggggcaaacccacctccattctttccctaaaatgagagctactaaggtttttaaaagctacagacctccttcaaaatttgaccacaagtaaaatccttgtggacccaggacagagagagtcatttctctgctcatgtaagtcaaacgcatacctgattgctccctgtgctctactgtttcactaaatcagactaaggcctacgtgactattcctgtaaattgtgcattcagttaaaggctaatcagaaactcaaataatgcaaccatttctctcaaacctacctatgatctagaagccctctccccacttcaagttgtcctgcctttctgaactaaatcaatgtacatctgatatatatatattgattaatgtctcatgtctccctaaattgtataaaaccaagctgtgcccacaagcttgggcacatgtcgtcagcactccctgaggctgtgtcacaggcatgtccttaatcttggaaattgaacttcctaaatctattgagattagtctcagatactctttggtttacaggtttgtttttatttcataacttcaattatttgacatgctaaagaaaatttgccaaatagcgcattctcttgtttatgtgttattgttgttgcaaaaataatatattttatatataatttatcatctatgtacattaccaaattgagtagcagatttattagtaagacccaaagtaatgaaaagttcagataccaattagcaacttagaaaaacaaattatgctacatttgtttgctgaaatgctacctattatttataaaaaataaacaatacaacataaaaggtttaattctcagtatttctattgagaaaaataagccaaatagatgagtacatactatattatttcattcttataaattctagagaataaaaactagtctaaagaaatatgaaaacatcagtacttttataaagaaatggtagaagaaaaggagaaaaacaaaaatatatctataaaagagcaagaggaattctgaggtgagttgacttgtcaccttcttgaaaatagagactttctttatcaaaatttactattgtacaggttaaatatgtgaattttatcatctgtcaattaaaactcataaaatttattacaagtaaacaagtgaaattttagacaaaaaagggatgataagaaggaacaaataaatacattaaatgtcagatacaccaaaaatgtatctgcctgacgcctagttgtctctgtatttttaggtaaatgcagcaaaatcacacaggttgtcgtggcaggaagtggattctgcaaaccacactaggccgtttatctctgtcctgtagttggttcagagcaactgaggccagctgtgaggcgcataggcccaggtactaggactcactcatgccagatataagccctgagacacgtacatagcccctccatgtgtgggttcacttttacatctgtacatgaagaaaccactgactcctaaataacatcatctatacacataggtaaaaaaattaaaaatatgatagttgttaaatgtttatcgcagaacaatttcaaaataaggcagcattttcccaaatacaatcattgtcatcaaaatcccccaggacgctctcatctactctgcgccctgccttcacctcagatgtcccaccccagagcttgctatatagtaacagacatgcaaatagttgactccctctcctgatgaaaaccagcccagccctgaccctgcagctctgggagtggagccccagccttgggattcccaagtgtttgtattcagtgatcaggactgaacacacaggactcaccatggagttggggctgagctgggttttccttgttgctatattagaaggtgattcatggagaactagagatattgagtgtgaatgggcatgaatgagagaaacagtgggtatgtgtggcaatttctgacttttgtgtctctgtgtttgcaggtgtccagtgtgaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagacacagtgaggggaagtcagtatgagcccagacacaaacctccctgcagaatgcctgggggaaatcagctgcagggggcgcacaggacccactgatcagagtcatccccagaggcaggtgcagatggaggctggtttcctgtcaggatgtgggacttcatctttttagagtttctctagggaacctctctaagttcagaattctgtgcttaccaatgccatccctacatatttttaaaatgattattttaatatgaaaacctattctcttatgcacgaaacacagactgatgcttacagagatgaaaagccctcaaccattgtcaccaggatcagagtattgaggaaactcaggggtacctggtgggtcttctccactcagactcaggacagaaacctcagtgagattccctgactaggacggtctttaggaattgtgatcgcagccaatagagagtctgggcaaggatcagtgtcatgtagaacttcacaggtttcacttctgacccttctcctgacactaaagtatacaacttagtatcagcactgatctggggccccttttgctcttagcccattctatttctttttatttgttgttgttgttcttgcttttccttgtagtgttcctgctccctgtaaagtggggatgtggctcttgctgccaaagctccaggtctcaagcccattccctgcagctcaggtggggctcaggctgtggctcctgcagccacgtggaagaggctgatgggactttcctctctcccattgctcagcaccctccagtgtgtcacgtggagactcacctgcgaatggaagtggccaacagtagtgaaggggatgagcttgtgtggacaaaatgggatgtggatgtgaaatttatcctgtgctgtgcaaagtagcacagagtgagtcaccttcctcaccagtagtgttagaaagagggtgtgaaagttgtcagaatcaaaatagatccacttgtgttaaaaccctgacaaatggaactaggaatgaccatgaaggaggtttcccatgcacatactcctgataacaagatcgaccataaatggattctgcttaaccacaacctttgatagaagccaccatgaccttataaaaatcacttctacaaggacatcttcccagcaaatcacggtttaaccctatactgatgccaaccttggtattgactctacaagcaaggaaaatcctctcaaaacaatttatgcaacccacctcattttcactcataaacctatggattgacatcgcctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgtacggttatctatgctgtctcaccatagagaatattacctatttcagaatgtatgtccatgattcgccgggtaaatacatataatacacaaatctggcttaataaagtctataatatatctcataaagaagtgctaaattggctagtgctatatatttttaagaaaatttcttttgactaagtccatatcgactttgtaaaagttcactttagcatacatatattacacgagccagaaattgtaacttttgcctaaaatcacaaattgcaaaatttaattgcttgcaaaaggtcacatgcttataatcaacttttttaaaaatttaaaatacttttttattttttatttttaaacataaatgaaataatttatttattgtttatgattaccgaaacataaaacctgctcaagaaaaagaaactgttttgtccttggaaaaaaagcactacctagtggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggtgatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtctaagaaaccattattatcatgacattaacctataaaaataggcgtatcacgaggccctttcgtctttgcgatcgcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtgtg
